(12) United States Patent
Janssen et al.

(10) Patent No.: US 9,952,202 B2
(45) Date of Patent: Apr. 24, 2018

(54) METHODS OF IDENTIFYING COMPOUNDS FOR THE TREATMENT OF FIBROSIS BY USING S1PR5

(71) Applicant: GALAPAGOS NV, Mechelen (BE)

(72) Inventors: Richard Antonius Jozef Janssen, Leiden (NL); Annemarie Nicolete Lekkerkerker, Palo Alto, CA (US); Jamil Aarbiou, Leiden (NL); Krista Ouwehand, Leiden (NL)

(73) Assignee: GALAPAGOS NV, Mechelen (BE)

( * ) Notice: Subject to any disclaimer, the term of this patent is extended or adjusted under 35 U.S.C. 154(b) by 95 days.

(21) Appl. No.: 14/775,828

(22) PCT Filed: Mar. 7, 2014

(86) PCT No.: PCT/EP2014/054442
§ 371 (c)(1),
(2) Date: Sep. 14, 2015

(87) PCT Pub. No.: WO2011/413988
PCT Pub. Date: Sep. 18, 2014

(65) Prior Publication Data
US 2016/0069868 A1    Mar. 10, 2016

Related U.S. Application Data

(60) Provisional application No. 61/781,473, filed on Mar. 14, 2013.

(51) Int. Cl.
| | |
|---|---|
| *G01N 33/50* | (2006.01) |
| *G01N 33/53* | (2006.01) |
| *G01N 33/566* | (2006.01) |
| *G01N 33/68* | (2006.01) |
| *C12Q 1/68* | (2018.01) |
| *A01K 67/027* | (2006.01) |
| *C12N 15/11* | (2006.01) |
| *C12N 15/113* | (2010.01) |
| *C07K 14/705* | (2006.01) |
| *G01N 24/08* | (2006.01) |

(52) U.S. Cl.
CPC ....... *G01N 33/5044* (2013.01); *A01K 67/027* (2013.01); *C12N 15/111* (2013.01); *C12N 15/113* (2013.01); *C12N 15/1137* (2013.01); *C12N 15/1138* (2013.01); *C12Q 1/6883* (2013.01); *C12Y 107/01007* (2013.01); *C12Y 201/01077* (2013.01); *C12Y 207/01014* (2013.01); *C12Y 207/01033* (2013.01); *C12Y 207/04006* (2013.01); *C12Y 207/08002* (2013.01); *C12Y 207/11001* (2013.01); *C12Y 304/22* (2013.01); *G01N 33/6893* (2013.01); *A01K 2207/10* (2013.01); *A01K 2207/30* (2013.01); *A01K 2227/105* (2013.01); *A01K 2267/03* (2013.01); *C07K 14/705* (2013.01); *C12N 2310/12* (2013.01); *C12N 2310/14* (2013.01); *C12N 2310/531* (2013.01); *C12N 2320/10* (2013.01); *C12N 2320/12* (2013.01); *C12Q 2600/158* (2013.01); *G01N 24/088* (2013.01); *G01N 33/50* (2013.01); *G01N 33/53* (2013.01); *G01N 2333/705* (2013.01); *G01N 2800/085* (2013.01)

(58) Field of Classification Search
CPC ........ A61K 38/00; A61K 38/16; A61K 38/17; A61K 38/18; C07K 14/47; C07K 14/475; G01N 33/53; G01N 33/6845; G01N 33/68; G01N 33/504
See application file for complete search history.

(56) References Cited

U.S. PATENT DOCUMENTS

| | | | |
|---|---|---|---|
| 6,277,981 B1 | 8/2001 | Tu et al. | |
| 6,416,951 B1 | 7/2002 | Schmidt et al. | |
| 6,500,615 B1 | 12/2002 | Schmidt et al. | |
| 7,141,383 B2 * | 11/2006 | Kostenis | C07K 14/705 435/7.2 |
| 2003/0198627 A1 | 10/2003 | Arts et al. | |
| 2006/0057559 A1* | 3/2006 | Xu | G01N 33/5029 435/4 |
| 2006/0240523 A1 | 10/2006 | Liaw et al. | |

(Continued)

FOREIGN PATENT DOCUMENTS

| | | |
|---|---|---|
| WO | 98046995 | 10/1998 |
| WO | 0181573 | 11/2001 |

(Continued)

OTHER PUBLICATIONS

Anliker et al. Cell surface receptors in lysophopholipid signaling. Sem Cell Dev Biol 15: 457-465, 2004.*
Bhatia et al. Innovatie approaches for enhancing cancer gene therapy. Discovery Med 15(84): 309-317, 2013.*
Bork, A. Powers and pitfalls in sequence analysis: the 70% hurdle. Genome Res 10: 398-400, 2000.*
Bork et al. Go hunting in sequence databases but watch out for the traps. Trends in Genetics. 12(10): 425-427, 1996.*
Brenner, S.E. Errors in genome function. Trends in Genetics 15(4): 132-133, 1999.*
Doerks et al. Protein annotation: detective work for function prediction. Trends in Genetics 14(6): 248-250, 1998.*

(Continued)

*Primary Examiner* — Bridget E Bunner
(74) *Attorney, Agent, or Firm* — Klauber & Jackson LLP

(57) ABSTRACT

The present invention relates to methods and assays for identifying agents useful in the treatment of fibrotic diseases, in particular diseases related to fibroblast migration and differentiation. The invention provides polypeptide and nucleic acid TARGETs, siRNA sequences based on these TARGETs and antibodies against the TARGETs. The invention is further related to pharmaceutical composition comprising siRNA sequences based on the TARGETs and antibodies against the TARGETs for use in the treatment of fibrotic disease. The invention further provides in vitro methods for inhibition of fibroblast migration and differentiation.

25 Claims, 8 Drawing Sheets

(56) References Cited

U.S. PATENT DOCUMENTS

2009/0191578 A1\* 7/2009 Mandala .............. C07K 14/705
                                                                435/15
2010/0226916 A1    9/2010 Sabbadini et al.
2013/0303490 A1    11/2013 Francois et al.

FOREIGN PATENT DOCUMENTS

| WO | 02/057311 A2  | 7/2002  |
|----|---------------|---------|
| WO | 04094636      | 11/2004 |
| WO | 08/055072 A2  | 5/2008  |
| WO | 011/139846 A2 | 11/2011 |

OTHER PUBLICATIONS

Im et al. Characterization of the human and mouse sphingosine 1-phosphate receptor, S1P5 (Egd-8): structure-activity relationship of sphingosine1-phosphate receptors. Biochemistry 40: 14053-14060, 2001.\*
Juengst, E.T. What next for human gene therapy? BMJ 326: 1410-1411, 2003.\*
Ngo et al. Computational complexity, protein structure prediction, and the Levinthal paradox. The Protein Folding Problem and Tertiary Structure Prediction, pp. 492-495, 1994.\*
Phillips, A.J. The challenge of gene therapy and DNA delivery. J Pharm Pharmacol 53: 1169-1174, 2001.\*
Pirollo et al. Targeted delivery of small interfering RNA: approaching effective cancer therapies. Cancer Res 68(5): 1247-1250, 2008.\*
Rubanyi, G.M. The future of human gene therapy. Mol Aspects Med 22:113-142, 2001.\*
Skolnick et al. From genes to protein structure and function: novel applications of computational approaches in the genomic era. Trends in Biotech 18(1): 34-39, 2000.\*
Smith et al. The challenges of genome sequence annotation or "The devil is in the details". Nature Biotech 15: 1222-1223, 1997.\*
Tokuriki et al. Stability effects of mutations and protein evolvability. Curr Opin Structural Biol 19: 596-604, 2009.\*
Urata et al. Sphingosine 1-phosphate induces alpha-smooth muscle actin expression in lung fibroblasts via rho-kinase. Kobe J Med Sci 51(1): 17-27, 2005.\*
Wells. J.A. Additivity of mutational effects in proteins. Biochemistry 29 (37): 8509-8517, 1990.\*
Ambros V (2004) The functions of animal microRNAs Nature 431(7006):350-355.
Bartel DP (2004) MicroRNAs: genomics, biogenesis, mechanism, and function Cell 116:281-297.
Bostrom H et al (1996) PDGF-A signaling is a critical event in lung alveolar myofibroblast development and alveogenesis Cell 85(6):863-73.
Cabellero S et al (2009) Anti-sphingosine-1-phosphate monoclonal antibodies inhibit angiogenesis and sub-retinal fibrosis in a murine model of laser-induced choroidal neovascularization. Exp Eye Res 88(3)367-377.
Chen CJ et al (1992) Multitarget-ribozyme directed to cleave at up to nine highly conserved HIV-1 env RNA regions inhibits HIV-1 replication—potential effectiveness against most presently sequenced HIV-1 isolates Nucleic Acids Res 20(17):4581-4589.
Cullen BR (2004) Derivation and function of small interfering RNAs and microRNAs Virus Research 102(1):3-9.
Eickelberg O et al (1999) Extracellular matrix deposition by primary human lung fibroblasts in response to TGF-beta1 and TGF-beta3 Am J Physiol 276(5 Pt 1): L814-824.
Gabbiani G (2003)The myofibroblast in wound healing and fibrocontractive diseases J Pathol. 200(4):500-503.
He L et al (2004) MicroRNAs: small RNAs with a big role in gene regulation Nat. Rev. Genet. 5(7):522-531.
Ho SP et al (1996) Potent antisense oligonucleotides to the human multidrug resistance-1 mRNA are rationally selected by mapping RNA-accessible sites with oligonucleotide libraries Nucl Acids Res 24(10):1901-1907.
Ho SP et al (1998) Mapping of RNA accessible sites for antisense experiments with oligonucleotide libraries Nature Biotechnology 16(1):59-63.
Kohan M et al (2010) Eotaxin-2/CCL24 and eotaxin-3/CCL26 exert differential profibrogenic effects on human lung fibroblasts Ann Allergy Asthma Immunol 104(1):66-72.
Mishra RK et al (1994) In vitro selection of antisense oligonucleotides targeted to a hairpin structure Life Sciences 317(11):977-982.
Moore BB et al (2008) Murine models of pulmonary fibrosis Am J Physiol Lung Cell Mol Physiol 294:L152-L160.
Pierce EM et al (2007) Idiopathic pulmonary fibrosis fibroblasts migrate and proliferate to CC chemokine ligand 21 Eur Respir J 29(6):1082-1093.
Puxeddu I et al (2006) The CC chemokine eotaxin/CCL11 has a selective profibrogenic effect on human lung fibroblasts J Allergy Clin Immunol 117(1)103-110.
Lima WF et al (1992) Implication of RNA structure on antisense oligonucleotide hybridization kinetics Biochem 31(48):12055-12061.
Scotton CJ et al (2007) Molecular targets in pulmonary fibrosis: the myofibroblast in focus Chest 132(4):1311-1321.
Sethupathy P et al (2006) TarBase: A comprehensive database of experimentally supported animal microRNA targets RNA 12(2):192-197.
Starkel P et al (2011) Animal models for the study of hepatic fibrosis Best Practice & Research Clinical Gastroenterology 25(2):319-333.
Swaney JS et al (2008) Sphingosine-1-phosphate (S1P) is a novel fibrotic mediator in the eye Exp Eye Res 87(4):367-375.
Todd NW et al (2012) Molecular and cellular mechanisms of pulmonary fibrosis Fibrogenesis Tissue Repair 5(1):11.
Ventura M et al (1993) Activation of HIV-specific ribozyme activity by self-cleavage Nucleic Acids Res 21(14)3249-3255.
Nei J et al (2011) Fibrosis in systemic sclerosis: emerging concepts and implications for targeted therapy. Autoimmunity Rev 10(5):267-275.
Wynn TA (2004) Fibrotic disease and the T(H)1/T(H)2 paradigm Nat Rev Immunol. 4:583-594.
Wynn TA (2007) Common and unique mechanisms regulate fibrosis in various fibroproliferative diseases J Clin Invest 117(3):524-529.
Ying SY el al (2004) Intron-derived microRNAs—fine tuning of gene functions Gene 342(1):25-28.
Zeisberg M et al (2005) Animal Models of Renal Fibrosis Fibrosis Research Methods in Molecular Medicine 117:261-272.
Johnson, Nicholas et al; Quantitative proteomics screen identifies a substrate repertoire of rhomboid protease RHBDL2 in human cells and implicates it in epithelial homeostasis; Scientific Reports (2017): 1-13.

\* cited by examiner

METHODS OF IDENTIFYING COMPOUNDS FOR THE TREATMENT OF FIBROSIS BY USING S1PR5

CROSS REFERENCE TO RELATED APPLICATIONS

The present application is a National Stage Application claiming the priority of PCT Application No. PCT/EP2014/054442 filed Mar. 7, 2014, which in turn, claims priority from U.S. Provisional Application Ser. No. 61/781,473 filed Mar. 14, 2013. Applicants claim the benefits of 35 U.S.C. § 120 as to the PCT Application and priority under 35 U.S.C. § 119 as to the said U.S. Provisional application, and the entire disclosures of both applications are incorporated herein by reference in their entireties.

TECHNICAL FIELD OF THE INVENTION

The present invention is in the field of molecular biology and biochemistry. The present invention relates to methods for identifying agents useful in treatment of fibrotic disease, in particular, agents that inhibit fibroblast migration and differentiation. Inhibition of fibroblast migration and differentiation is useful in the prevention and/or treatment of fibrotic conditions and other diseases where processes of fibroblast migration and differentiation play role. In particular, the present invention provides methods for identifying agents for use in the prevention and/or treatment of fibrotic diseases.

BACKGROUND OF THE INVENTION

Fibrosis is characterized by excessive deposition of scar tissue. Fibrosis is one of the largest groups of diseases for which there is no therapy. Fibrosis is responsible for morbidity and mortality associated with organ failure in a variety of chronic diseases affecting the lungs, heart, kidneys, liver and skin. It has been estimated that nearly 45% of all deaths in the developed world are caused by fibrotic conditions which include: cardiovascular disease, pulmonary fibrosis, diabetic nephropathy and liver cirrhosis (Wynn, 2004).

Fibrosis, and especially idiopathic pulmonary fibrosis, is a disease that is receiving increasing attention. Unfortunately, little is known about the pathogenesis of fibrosis and only recently the various cellular and molecular processes that contribute to this disease have been unveiled. The overall consensus is that fibrosis is a result of an imbalance in the immune and repair response following infection and/or tissue damage (reviewed by Lekkerkerker et al, 2012) These responses are the result of an intricate interplay between various cell types such as epithelial cells, fibroblasts, macrophages, fibrocytes, smooth muscle cells and endothelial cells. An imbalance in the activity in one or more of these cell types is expected to contribute to fibrosis.

A common theme of fibrotic diseases is the abnormal persistence of a particular specialized form of fibroblast, termed the myofibroblast (Gabbiani, 2003; Wynn, 2008). In the presence of profibrotic stimuli such as TGFβ and extracellular matrix (ECM) components (e.g. collagen I and fibronectin) fibroblasts differentiate into a myofibroblast phenotype, characterized by expression of α-smooth muscle actin (αSMA), secretion of collagen type I and III and increased migration and contractility (Wynn, 2007). These cells contribute to excessive wound healing and to excessive deposition of extracellular matrix proteins (fibronectin, collagen, and/or laminin). Several sources of fibroblasts have been put forward including proliferation of resident fibroblasts, generation of fibroblasts from epithelial cells through epithelial mesenchymal transition (EMT), differentiation of circulating fibrocytes or mesenchymal progenitor cells.

It is commonly believed that fibroblasts are the major contributor to the pool of myofibroblasts in fibrogenic foci (Lekkerkerker et al, 2012). A prerequisite for this contribution is the migration of fibroblasts towards foci and subsequent expansion and differentiation. Many factors have been identified over the years that activate the fibroblast and thereby enhance their migratory and/or proliferative capacity. These include growth factors PDGF, CTGF and TGFβ, but also chemokines such as CCL11 (Puxeddu et al., 2006), CCL21 (Pierce et al., 2007), CCL24 and CCL26 (Kohan et al., 2010).

TGFβ is a pleiotropic cytokine that has many versatile effects on the fibrogenic process in the lung, including but not restricted to the already discussed potentiation of EMT. TGFβ isoforms have also been shown to regulate deposition of many components of the ECM components (Eickelberg et al., 1999) and affect the migratory and differentiation potential of fibroblasts towards myofibroblasts (Scotton et al., 2007).

Another factor, PDGF, serves as a growth factor for mesenchymal cells and was shown to be essential in myofibroblast development as PDGF-A knock-out mice were devoid of alveolar myofibroblast progenitors (Bostrom et al., 1996).

In the past decades much effort has been put into the development of in vitro and in vivo models to unravel the molecular mechanisms regulating fibrotic processes in the lung (Lekkerkerker et al, 2012; Todd et al, 2012). It is, however, important to use these cells under physiological conditions and in a disease-relevant context. Hence, the biological screening assays utilizing primary cells in functional assays relevant for fibrosis in combination with functional genomics can give invaluable insight in the possible molecular mechanisms contributing to fibrosis and identify novel genetic targets for treatment of fibrosis.

The process of fibroblast migration and differentiation into myofibroblasts is still poorly understood, and is a necessary prerequisite for developing novel, rational antifibrotic strategies. Therefore, there is a clear need to understand molecular and cellular processes underlying fibrosis, and, in particular, the biology of fibroblasts, and to provide new methods of identifying targets and compounds useful for treatment of fibrosis and fibrosis-related conditions.

SUMMARY OF THE INVENTION

The present invention is based on the discovery that agents that inhibit the expression and/or activity of the TARGETS disclosed herein are capable of inhibiting the differentiation and migration of fibroblasts as indicated by a inhibition of fibroblast migration and the inhibition of the expression and/or release of markers of fibroblast differentiation into myofibroblasts, in particular a suppression of the release or expression of α-smooth muscle actin. The present invention, therefore, provides TARGETS which play a role in fibroblast migration and differentiation, methods for screening for agents capable of down-regulating the expression and/or activity of TARGETS and the use of these agents in the prevention and/or treatment of fibrotic diseases, in particular diseases associated with fibroblast migration and differentiation. The present invention provides TARGETS which are involved in the differentiation and biology of fibroblasts, in particular with fibrotic diseases. In a particular aspect, the present invention provides TARGETS which are involved in or otherwise associated with development of fibrotic diseases.

The present invention relates to a method for identifying a compound useful for the treatment of fibrosis, said method comprising: contacting a test compound with a TARGET polypeptide, fragments and functional derivatives thereof, determining a binding affinity of the test compound to said polypeptide or an activity of said polypeptide, contacting the test compound with a population of fibroblasts, measuring a property related to fibroblast migration or differentiation, and identifying a compound capable of inhibiting fibroblast migration or differentiation and which either demonstrates a binding affinity to said polypeptide or is able to inhibit the activity of said polypeptide.

The present invention further relates to a method for identifying a compound useful for the treatment of fibrosis, said method comprising: contacting a test compound with population of fibroblasts and expressing a TARGET polypeptide, measuring expression and/or amount of said polypeptide in said cells, measuring a property related to fibroblast migration or differentiation, and identifying a compound which reduces the expression and/or amount of said polypeptide and which is capable of inhibiting fibroblast migration or differentiation.

The present invention further relates to a method for identifying a compound that inhibits fibroblast migration and differentiation, said method comprising: contacting a test compound with population of fibroblasts and expressing a TARGET polypeptide, measuring expression and/or amount of said polypeptide in said cells, measuring a property related to fibroblast migration or differentiation, and identifying a compound which reduces the expression and/or amount of said polypeptide and which is capable of inhibiting fibroblast migration or differentiation.

The present invention provides a method for identifying a compound that inhibits fibroblast migration and differentiation said method comprising: contacting a test compound with a TARGET polypeptide, fragments or structurally functional derivatives thereof, determining a binding affinity of the test compound to said polypeptide or expression or an activity of said polypeptide, and identifying a compound fibroblast migration and differentiation as a compound which demonstrates a binding affinity to said polypeptide and/or is able to inhibit the expression or activity of said polypeptide.

The present invention also relates to:
a) pharmaceutical compositions comprising an antibody or a fragment thereof which specifically binds to a TARGET polypeptide, for use in the treatment of a fibrotic condition.
b) pharmaceutical compositions comprising an agent selected from the group consisting of an antisense polynucleotide, a ribozyme, a small interfering RNA (siRNA), mirroRNA (miRNA) and a short-hairpin RNA (shRNA) for use in the treatment of a fibrotic condition, wherein said agent comprises a nucleic acid sequence complementary to, or engineered from, a naturally-occurring polynucleotide sequence of about 17 to about 30 contiguous nucleotides of a nucleic acid sequence selected encoding a TARGET polypeptide for use in the treatment of a fibrotic condition.

Another aspect of this invention relates to an in vitro method of inhibiting fibroblast migration and differentiation, said method comprising contacting a population of fibroblasts with an inhibitor of an activity or expression of a TARGET polypeptide.

DETAILED DESCRIPTION

Definitions

Figure 1:
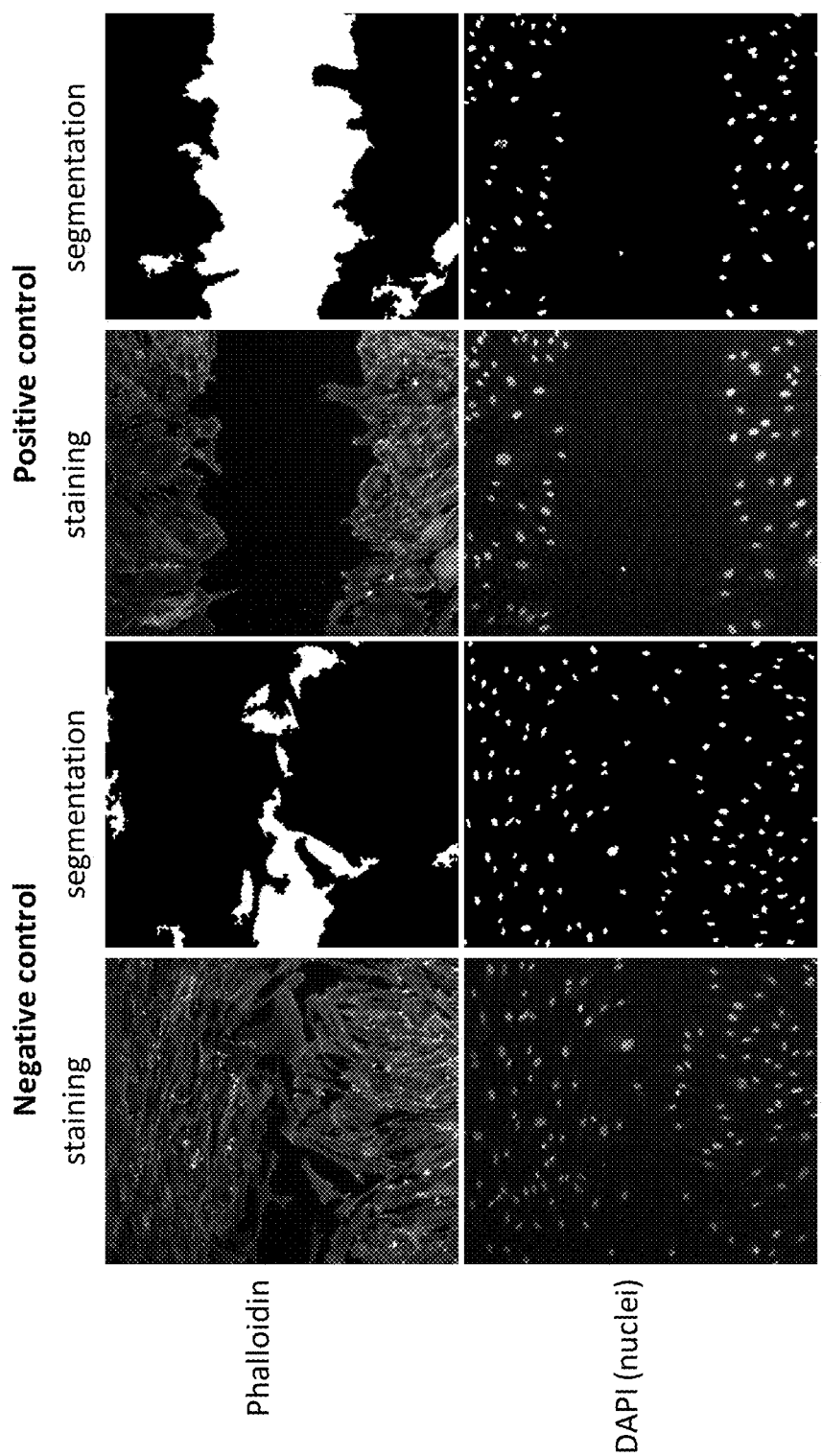
FIG. 1 shows principles of image segmentation based on phalloidin staining and DAPI staining of nuclei.

The following terms are intended to have the meanings presented below and are useful in understanding the description and intended scope of the present invention.

The term 'agent' means any molecule, including polypeptides, polynucleotides, natural products and small molecules. In particular the term agent includes compounds such as test compounds or drug candidate compounds.

The term 'activity inhibitory agent' or 'activity inhibiting agent' means an agent, e.g. a polypeptide, small molecule, compound designed to interfere or capable of interfering selectively with the activity of a specific polypeptide or protein normally expressed within or by a cell.

The term 'agonist' refers to an agent that stimulates the receptor the agent binds to in the broadest sense.

As used herein, the term 'antagonist' is used to describe an agent that does not provoke a biological response itself upon binding to a receptor, but blocks or dampens agonist-mediated responses, or prevents or reduces agonist binding and, thereby, agonist-mediated responses.

The term 'assay' means any process used to measure a specific property of an agent, including a compound. A 'screening assay' means a process used to characterize or select compounds based upon their activity from a collection of compounds.

The term 'binding affinity' is a property that describes how strongly two or more compounds associate with each other in a non-covalent relationship. Binding affinities can be characterized qualitatively, (such as 'strong', 'weak', 'high', or low') or quantitatively (such as measuring the KD).

The term 'carrier' means a non-toxic material used in the formulation of pharmaceutical compositions to provide a medium, bulk and/or useable form to a pharmaceutical composition. A carrier may comprise one or more of such materials such as an excipient, stabilizer, or an aqueous pH buffered solution. Examples of physiologically acceptable carriers include aqueous or solid buffer ingredients including phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN®, polyethylene glycol (PEG), and PLURONICS®.

The term 'complex' means the entity created when two or more compounds bind to, contact, or associate with each other.

The term 'compound' is used herein in the context of a 'test compound' or a 'drug candidate compound' described in connection with the assays of the present invention. As such, these compounds comprise organic or inorganic compounds, derived synthetically or from natural sources. The compounds include inorganic or organic compounds such as polynucleotides (e.g. siRNA or cDNA), lipids or hormone analogs. Other biopolymeric organic test compounds include peptides comprising from about 2 to about 40 amino acids and larger polypeptides comprising from about 40 to about 500 amino acids, including polypeptide ligands, enzymes, receptors, channels, antibodies or antibody conjugates.

The term 'condition' or 'disease' means the overt presentation of symptoms (i.e., illness) or the manifestation of abnormal clinical indicators (for example, biochemical indicators). Alternatively, the term 'disease' refers to a genetic or environmental risk of or propensity for developing such symptoms or abnormal clinical indicators.

The term 'contact' or 'contacting' means bringing at least two moieties together, whether in an in vitro system or an in vivo system.

The term 'derivatives of a polypeptide' relates to those peptides, oligopeptides, polypeptides, proteins and enzymes that comprise a stretch of contiguous amino acid residues of the polypeptide and that retain a biological activity of the protein, for example, polypeptides that have amino acid mutations compared to the amino acid sequence of a naturally-occurring form of the polypeptide. A derivative may further comprise additional naturally occurring, altered, glycosylated, acylated or non-naturally occurring amino acid residues compared to the amino acid sequence of a naturally occurring form of the polypeptide. It may also contain one or more non-amino acid substituents, or heterologous amino acid substituents, compared to the amino acid sequence of a naturally occurring form of the polypeptide, for example a reporter molecule or other ligand, covalently or non-covalently bound to the amino acid sequence.

The term 'derivatives of a polynucleotide' relates to DNA-molecules, RNA-molecules, and oligonucleotides that comprise a stretch of nucleic acid residues of the polynucleotide, for example, polynucleotides that may have nucleic acid mutations as compared to the nucleic acid sequence of a naturally occurring form of the polynucleotide. A derivative may further comprise nucleic acids with modified backbones such as PNA, polysiloxane, and 2'-O-(2-methoxy) ethyl-phosphorothioate, non-naturally occurring nucleic acid residues, or one or more nucleic acid substituents, such as methyl-, thio-, sulphate, benzoyl-, phenyl-, amino-, propyl-, chloro-, and methanocarbanucleosides, or a reporter molecule to facilitate its detection.

The term 'endogenous' shall mean a material that a mammal naturally produces. Endogenous in reference to the term 'enzyme', 'protease', 'kinase', or G-Protein Coupled Receptor ('GPCR') shall mean that which is naturally produced by a mammal (for example, and not by limitation, a human). In contrast, the term non-endogenous in this context shall mean that which is not naturally produced by a mammal (for example, and not by limitation, a human) Both terms can be utilized to describe both in vivo and in vitro systems. For example, and without limitation, in a screening approach, the endogenous or non-endogenous TARGET may be in reference to an in vitro screening system. As a further example and not limitation, where the genome of a mammal has been manipulated to include a non-endogenous TARGET, screening of a candidate compound by means of an in vivo system is feasible.

The term 'expressible nucleic acid' means a nucleic acid coding for or capable of encoding a proteinaceous molecule, peptide or polypeptide, and may include an RNA molecule, or a DNA molecule.

The term 'expression' comprises both endogenous expression and non-endogenous expression, including overexpression by transduction.

The term 'expression inhibitory agent' or 'expression inhibiting agent' means an agent, e.g. a polynucleotide designed to interfere or capable of interfering selectively with the transcription, translation and/or expression of a specific polypeptide or protein normally expressed within or by a cell. More particularly and by example, 'expression inhibitory agent' comprises a DNA or RNA molecule that contains a nucleotide sequence identical to or complementary to at least about 15-30, particularly at least 17, sequential nucleotides within the polyribonucleotide sequence coding for a specific polypeptide or protein. Exemplary such expression inhibitory molecules include ribozymes, microRNAs, double stranded siRNA molecules, self-complementary single-stranded siRNA molecules, genetic antisense constructs, and synthetic RNA antisense molecules with modified stabilized backbones.

The term "RNAi inhibitor" refers to any molecule that can down regulate, reduce or inhibit RNA interference function or activity in a cell or organism. An RNAi inhibitor can down regulate, reduce or inhibit RNAi (e.g., RNAi mediated cleavage of a target polynucleotide, translational inhibition, or transcriptional silencing) by interaction with or interfering with the function of any component of the RNAi pathway, including protein components such as RISC, or nucleic acid components such as miRNAs or siRNAs. A RNAi inhibitor can be an siNA molecule, an antisense molecule, an aptamer, or a small molecule that interacts with or interferes with the function of RISC, a miRNA, or an siRNA or any other component of the RNAi pathway in a cell or organism. By inhibiting RNAi (e.g., RNAi mediated cleavage of a target polynucleotide, translational inhibition, or transcriptional silencing), a RNAi inhibitor of the invention can be used to modulate (e.g., down regulate) the expression of a target gene.

The term "microRNA" or "miRNA" or "miR" as used herein refers to its meaning as is generally accepted in the art. More specifically, the term refers a small double-stranded RNA molecules that regulate the expression of target messenger RNAs either by mRNA cleavage, translational repression/inhibition or heterochromatic silencing (see for example Ambros, 2004, Nature, 431, 350-355; Barrel, 2004, Cell, 1 16, 281-297; Cullen, 2004, Virus Research., 102, 3-9; He et al, 2004, Nat. Rev. Genet., 5, 522-531; Ying el al, 2004, Gene, 342, 25-28; and Sethupathy et al, 2006, RNA, 12:192-197). As used herein, the term includes mature single stranded miRNAs, precursor miRNAs (pre-miR), and variants thereof, which may be naturally occurring. In some instances, the term "miRNA" also includes primary miRNA transcripts and duplex miRNAs.

The term 'fragment of a polynucleotide' relates to oligonucleotides that comprise a stretch of contiguous nucleic acid residues that exhibit substantially a similar, but not necessarily identical, activity as the complete sequence. In a particular aspect, 'fragment' may refer to a oligonucleotide comprising a nucleic acid sequence of at least 5 nucleic acid residues (preferably, at least 10 nucleic acid residues, at least 15 nucleic acid residues, at least 20 nucleic acid residues, at least 25 nucleic acid residues, at least 40 nucleic acid residues, at least 50 nucleic acid residues, at least 60 nucleic acid residues, at least 70 nucleic acid residues, at least 80 nucleic acid residues, at least 90 nucleic acid residues, at least 100 nucleic acid residues, at least 125 nucleic acid residues, at least 150 nucleic acid residues, at least 175 nucleic acid residues, at least 200 nucleic acid residues, or at least 250 nucleic acid residues) of the nucleic acid sequence of said complete sequence.

The term 'fragment of a polypeptide' relates to peptides, oligopeptides, polypeptides, proteins, monomers, subunits and enzymes that comprise a stretch of contiguous amino acid residues, and exhibit substantially a similar, but not necessarily identical, functional or expression activity as the complete sequence. In a particular aspect, 'fragment' may refer to a peptide or polypeptide comprising an amino acid sequence of at least 5 amino acid residues (preferably, at least 10 amino acid residues, at least 15 amino acid residues, at least 20 amino acid residues, at least 25 amino acid residues, at least 40 amino acid residues, at least 50 amino acid residues, at least 60 amino acid residues, at least 70 amino acid residues, at least 80 amino acid residues, at least 90 amino acid residues, at least 100 amino acid residues, at least 125 amino acid residues, at least 150 amino acid residues, at least 175 amino acid residues, at least 200 amino acid residues, or at least 250 amino acid residues) of the amino acid sequence of said complete sequence.

The term 'hybridization' means any process by which a strand of nucleic acid binds with a complementary strand through base pairing. The term 'hybridization complex' refers to a complex formed between two nucleic acid sequences by virtue of the formation of hydrogen bonds between complementary bases. A hybridization complex may be formed in solution (for example, C0t or R0t analysis) or formed between one nucleic acid sequence present in solution and another nucleic acid sequence immobilized on a solid support (for example, paper, membranes, filters, chips, pins or glass slides, or any other appropriate substrate to which cells or their nucleic acids have been fixed). The term "stringent conditions" refers to conditions that permit hybridization between polynucleotides and the claimed polynucleotides. Stringent conditions can be defined by salt concentration, the concentration of organic solvent, for example, formamide, temperature, and other conditions well known in the art. In particular, reducing the concentration of salt, increasing the concentration of formamide, or raising the hybridization temperature can increase stringency. The term 'standard hybridization conditions' refers to salt and temperature conditions substantially equivalent to 5×SSC and 65° C. for both hybridization and wash. However, one skilled in the art will appreciate that such 'standard hybridization conditions' are dependent on particular conditions including the concentration of sodium and magnesium in the buffer, nucleotide sequence length and concentration, percent mismatch, percent formamide, and the like. Also important in the determination of "standard hybridization conditions" is whether the two sequences hybridizing are RNA-RNA, DNA-DNA or RNA-DNA. Such standard hybridization conditions are easily determined by one skilled in the art according to well known formulae, wherein hybridization is typically 10-20NC below the predicted or determined Tm with washes of higher stringency, if desired.

The term 'inhibit' or 'inhibiting', in relationship to the term 'response' means that a response is decreased or prevented in the presence of a compound as opposed to in the absence of the compound.

The term 'inhibition' refers to the reduction, down regulation of a process or the elimination of a stimulus for a process, which results in the absence or minimization of the expression or activity of a protein or polypeptide.

The term 'induction' refers to the inducing, up-regulation, or stimulation of a process, which results in the expression, enhanced expression, activity, or increased activity of a protein or polypeptide.

The term 'ligand' means an endogenous, naturally occurring molecule specific for an endogenous, naturally occurring receptor.

The term 'pharmaceutically acceptable salts' refers to the non-toxic, inorganic and organic acid addition salts, and base addition salts, of compounds which inhibit the expression or activity of TARGETS as disclosed herein. These salts can be prepared in situ during the final isolation and purification of compounds useful in the present invention.

The term 'polypeptide' relates to proteins (such as TARGETS), proteinaceous molecules, fragments of proteins, monomers or portions of polymeric proteins, peptides, oligopeptides and enzymes (such as kinases, proteases, GPCR's etc.).

The term 'polynucleotide' means a polynucleic acid, in single or double stranded form, and in the sense or antisense orientation, complementary polynucleic acids that hybridize to a particular polynucleic acid under stringent conditions, and polynucleotides that are homologous in at least about 60 percent of its base pairs, and more particularly 70 percent of its base pairs are in common, particularly 80 percent, most particularly 90 percent, and in a special embodiment 100 percent of its base pairs. The polynucleotides include polyribonucleic acids, polydeoxyribonucleic acids, and synthetic analogues thereof. It also includes nucleic acids with modified backbones such as peptide nucleic acid (PNA), polysiloxane, and 2'-O-(2-methoxy)ethylphosphorothioate. The polynucleotides are described by sequences that vary in length, that range from about 10 to about 5000 bases, particularly about 100 to about 4000 bases, more particularly about 250 to about 2500 bases. One polynucleotide embodiment comprises from about 10 to about 30 bases in length. A special embodiment of polynucleotide is the polyribonucleotide of from about 17 to about 22 nucleotides, more commonly described as small interfering RNAs (siRNAs-double stranded siRNA molecules or self-complementary single-stranded siRNA molecules (shRNA)). Another special embodiment are nucleic acids with modified backbones such as peptide nucleic acid (PNA), polysiloxane, and 2'-O-(2-methoxy)ethylphosphorothioate, or including non-naturally occurring nucleic acid residues, or one or more nucleic acid substituents, such as methyl-, thio-, sulphate, benzoyl-, phenyl-, amino-, propyl-, chloro-, and methanocarbanucleosides, or a reporter molecule to facilitate its detection. Polynucleotides herein are selected to be 'substantially' complementary to different strands of a particular target DNA sequence. This means that the polynucleotides must be sufficiently complementary to hybridize with their respective strands. Therefore, the polynucleotide sequence need not reflect the exact sequence of the target sequence. For example, a non-complementary nucleotide fragment may be attached to the 5' end of the polynucleotide, with the remainder of the polynucleotide sequence being complementary to the strand. Alternatively, non-complementary bases or longer sequences can be interspersed into the polynucleotide, provided that the polynucleotide sequence has sufficient complementarity with the sequence of the strand to hybridize therewith under stringent conditions or to form the template for the synthesis of an extension product.

The term 'preventing' or 'prevention' refers to a reduction in risk of acquiring or developing a disease or disorder (i.e., causing at least one of the clinical symptoms of the disease not to develop) in a subject that may be exposed to a disease-causing agent, or predisposed to the disease in advance of disease onset.

The term 'prophylaxis' is related to and encompassed in the term 'prevention', and refers to a measure or procedure the purpose of which is to prevent, rather than to treat or cure a disease. Non-limiting examples of prophylactic measures may include the administration of vaccines; the administration of low molecular weight heparin to hospital patients at risk for thrombosis due, for example, to immobilization; and the administration of an anti-malarial agent such as chloroquine, in advance of a visit to a geographical region where malaria is endemic or the risk of contracting malaria is high.

The term 'subject' includes humans and other mammals.

The term 'TARGET' or 'TARGETS' means the protein(s) identified in accordance with the assays described herein and determined to be involved in fibroblast migration and differentiation. The term TARGET or TARGETS includes and contemplates alternative species forms, isoforms, and variants, such as splice variants, allelic variants, alternate in frame exons, and alternative or premature termination or start sites, including known or recognized isoforms or variants thereof such as indicated in Table 1. The NCBI accession numbers are provided to assist a skilled person to identify the transcripts and polypeptides. However, the term TARGET or TARGETS is not limited to those particular versions of the sequences and encompasses functional variants of nucleic acids and polypeptides corresponding to those sequences.

'Therapeutically effective amount' or 'effective amount' means that amount of a compound or agent that will elicit the biological or medical response of a subject that is being sought by or is accepted by a medical doctor or other clinician.

The term 'treating' or 'treatment' of any disease or disorder refers, in one embodiment, to ameliorating the disease or disorder (i.e., arresting the disease or reducing the manifestation, extent or severity of at least one of the clinical symptoms thereof). Accordingly, 'treating' refers to both therapeutic treatment and prophylactic or preventative measures. Those in need of treating include those already with the disorder as well as those in which the disorder is to be prevented. The related term 'treatment,' as used herein, refers to the act of treating a disorder, symptom, disease or condition. In another embodiment 'treating' or 'treatment' refers to ameliorating at least one physical parameter, which may not be discernible by the subject. In yet another embodiment, 'treating' or 'treatment' refers to modulating the disease or disorder, either physically, (e.g., stabilization of a discernible symptom), physiologically, (e.g., stabilization of a physical parameter or of a physiologically measurable parameter), or both. In a further embodiment, 'treating' or 'treatment' relates to slowing the progression of the disease.

The term "vectors" also relates to plasmids as well as to viral vectors, such as recombinant viruses, or the nucleic acid encoding the recombinant virus.

The term "vertebrate cells" means cells derived from animals having vertebrate structure, including fish, avian, reptilian, amphibian, marsupial, and mammalian species. Preferred cells are derived from mammalian species, and most preferred cells are human cells. Mammalian cells include feline, canine, bovine, equine, caprine, ovine, porcine, murine, such as mice and rats, and rabbits.

As used herein the term 'fibrotic diseases' refers to diseases characterized by excessive or persistent scarring, particularly due to excessive or abnormal production, deposition of extracellular matrix, and are that are associated with the abnormal accumulation of cells and/or fibronectin and/or collagen and/or increased fibroblast recruitment and include but are not limited to fibrosis of individual organs or tissues such as the heart, kidney, liver, joints, lung, pleural tissue, peritoneal tissue, skin, cornea, retina, musculoskeletal and digestive tract. In particular aspects, the term fibrotic diseases refers to idiopathic pulmonary fibrosis (IPF), cystic fibrosis, other diffuse parenchymal lung diseases of different etiologies including iatrogenic drug-induced fibrosis, occupational and/or environmental induced fibrosis, granulomatous diseases (sarcoidosis, hypersensitivity pneumonia), collagen vascular disease, alveolar proteinosis, langerhans cell granulomatosis, lymphangioleiomyomatosis, inherited diseases (Hermansky-Pudlak Syndrome, tuberous sclerosis, neurofibromatosis, metabolic storage disorders, familial interstitial lung disease), radiation induced fibrosis, chronic obstructive pulmonary disease (COPD), scleroderma, bleomycin induced pulmonary fibrosis, chronic asthma, silicosis, asbestos induced pulmonary fibrosis, acute respiratory distress syndrome (ARDS), kidney fibrosis, tubulointerstitium fibrosis, glomerular nephritis, focal segmental glomerular sclerosis, IgA nephropathy, hypertension, Alport syndrome, gut fibrosis, liver fibrosis, cirrhosis, alcohol induced liver fibrosis, toxic/drug induced liver fibrosis, hemochromatosis, nonalcoholic steatohepatitis (NASH), biliary duct injury, primary biliary cirrhosis, infection induced liver fibrosis, viral induced liver fibrosis, autoimmune hepatitis, corneal scarring, hypertrophic scarring, Dupuytren disease, keloids, cutaneous fibrosis, cutaneous scleroderma, systemic sclerosis, spinal cord injury/fibrosis, myelofibrosis, vascular restenosis, atherosclerosis, arteriosclerosis, Wegener's granulomatosis and Peyronie's disease. More particularly, the term "fibrotic diseases" refers to idiopathic pulmonary fibrosis (IPF).

The term "fibroblast" or "fibroblasts" refers to cells derived from mesenchymal progenitor cells and which are present in flattened, irregular-shaped connective tissue and provide the structural framework of cell(s), ubiquitous in fibrous connective tissue by generating and/or secreting components of the extracellular matrix factors, including type I collagen and hyaluronic acid.

The term "myofibroblast" refers to fibroblasts that transitioned from fibroblast into fibroblasts that are differentiated towards a smooth muscle cell-like phenotype, and which express high levels of alpha smooth muscle actin (αSMA) and are positive for αSMA.

The term "fibroblast migration and differentiation" or "fibroblast migration and transition" refers to processes of fibroblast migration and differentiation (or alternatively, transition) into myofibroblasts respectively. Such processes are known to play role in onset and development of fibrotic conditions. In particular aspect, fibroblast differentiation and migration do not have to occur simultaneously. Each of these processes independently contributes to the development of fibrotic conditions. Fibroblast migration may lead to excessive accumulation of fibroblasts which directly or indirectly contribute to fibrosis. Fibroblast to myofibroblast differentiation (or transition) leads to the formation of cell types that produce excessive extracellular matrix factors contributing to onset and development of fibrosis Targets Applicant's invention is relevant to the treatment, prevention and alleviation of a fibrotic disease.

The present invention is based on extensive work by the present inventors to develop an in vitro (cell-free or cell based) assay system suitable to provide a scientifically valid substitute for the naturally occurring in vivo process of fibroblast migration and differentiation. The process of fibroblast migration and differentiation is known to be involved in fibrosis, however it is a complex process. The present invention provides an artificial model for the natural system which is suitable for the identification of compounds able to inhibit fibroblast migration and differentiation, and, thus, identify compounds that may be useful in the treatment and/or prevention of fibrosis.

The present invention provides methods for assaying for drug candidate compounds useful in treatment of fibrotic conditions, comprising contacting the compound with a cell expressing a TARGET, and determining the relative amount or degree of inhibition of fibroblast migration and differentiation in the presence and/or absence of the compound. The present invention provides methods for assaying for drug candidate compounds useful in treatment of fibrotic conditions, particularly useful in reducing fibroblast migration and/or differentiation, comprising contacting the compound with a cell expressing a TARGET, and determining the relative amount or degree of inhibition of the expression or activity of the TARGET, whereby inhibition of expression or activity of the TARGET is associated with or results in inhibition of or reduced fibroblast migration and/or differentiation in the presence and/or absence of the compound. Such methods may be used to identify target proteins that act to inhibit said differentiation; alternatively, they may be used to identify compounds that down-regulate or inhibit the expression or activity of TARGET proteins. The invention provides methods for assaying for drug candidate compounds useful in the treatment of fibrosis, comprising contacting the compound with a TARGET, under conditions wherein the expression or activity of the TARGET may be measured, and determining whether the TARGET expression or activity is altered in the presence of the compound, contacting a population of fibroblasts with said test compound and measuring a property related to fibroblast migration or differentiation. Exemplary such methods can be designed and determined by the skilled artisan. Particular such exemplary methods are provided herein.

The present invention is based on the inventors' discovery that the TARGET polypeptides and their encoding nucleic acids, identified as a result of screens described below in the Examples, are factors involved in the fibrosis and in particular in fibroblast migration and differentiation. A reduced activity or expression of the TARGET polypeptides and/or their encoding polynucleotides is causative, correlative or associated with reduced or inhibited fibroblast migration and differentiation. Alternatively, a reduced activity or expression of the TARGET polypeptides and/or their encoding polynucleotides is causative, correlative or associated with decrease of the markers of fibroblast differentiation.

In a particular embodiment of the invention, the TARGET polypeptide comprises an amino acid sequence selected from the group consisting of SEQ ID NO: 57-112 as listed in Table 1.

TABLE 1

| Target Gene Symbol | GenBank Nucleic Acid Acc #: | SEQ ID NO: DNA | GenBank Protein Acc # | SEQ ID NO: Protein | NAME | Class |
| --- | --- | --- | --- | --- | --- | --- |
| S1PR5 | NM_030760.4 | 1 | NP_110387.1 | 57 | sphingosine-1- phosphate receptor 5 | GPCR |
|  | NM_001166215.1 | 2 | NP_001159687.1 | 58 |  |  |
| RHBDL2 | NM_017821.3 | 3 | NP_060291.2 | 59 | rhomboid, veinlet-like 2 (*Drosophila*) | Protease |
| MAP4K2 | NM_004579.3 | 4 | NP_004570.2 | 60 | mitogen-activated protein kinase kinase kinase kinase 2 | Kinase |
| SHPK | NM_013276.2 | 5 | NP_037408.2 | 61 | sedoheptulokinase | Kinase |
| PANK3 | NM_024594.3 | 6 | NP_078870.1 | 62 | pantothenate kinase 3 | Kinase |
| AK8 | NM_152572.2 | 7 | NP_689785.1 | 63 | adenylate kinase 8 | Kinase |
| AMH | NM_000479.3 | 8 | NP_000470.2 | 64 | anti-Mullerian hormone | Secreted/ Extracellular |
| CAPN7 | NM_014296.2 | 9 | NP_055111.1 | 65 | calpain 7 | Protease |
| CHPT1 | NM_020244.2 | 10 | NP_064629.2 | 66 | choline phosphotransferase 1 | Transferase |
| GMPR2 | NM_016576.3 | 11 | NP_057660.2 | 67 | guanosine monophosphate reductase 2 | Oxidoreductase |
|  | NM_001002000.1 | 12 | NP_001002000.1 | 68 |  |  |
|  | NM_001002001.1 | 13 | NP_001002001.1 | 69 |  |  |
|  | NM_001002002.1 | 14 | NP_001002002.1 | 70 |  |  |
| KCNMB3 | NM_171828.1 | 15 | NP_741979.1 | 71 | potassium large conductance calcium-activated channel, subfamily M beta member 3 | Ion Channel |
|  | NM_171829.2 | 16 | NP_741980.1 | 72 |  |  |
|  | NM_171830.1 | 17 | NP_741981.1 | 73 |  |  |
|  | NM_014407.3 | 18 | NP_055222.3 | 74 |  |  |
|  | NM_001163677.1 | 19 | NP_001157149.1 | 75 |  |  |
| MAMDC4 | NM_206920.2 | 20 | NP_996803.2 | 76 | MAM domain containing 4 | Secreted/ Extracellular |
| PCMT1 | NM_005389.2 | 21 | NP_005380.2 | 77 | protein-L-isoaspartate (D-aspartate) O-methyltransferase | Transferase |
|  | NM_001252049.1 | 22 | NP_001238978.1 | 78 |  |  |
|  | NM_001252050.1 | 23 | NP_001238979.1 | 79 |  |  |
|  | NM_001252051.1 | 24 | NP_001238980.1 | 80 |  |  |
|  | NM_001252052.1 | 25 | NP_001238981.1 | 81 |  |  |
|  | NM_001252053.1 | 26 | NP_001238982.1 | 82 |  |  |

TABLE 1-continued

| Target Gene Symbol | GenBank Nucleic Acid Acc #: | SEQ ID NO: DNA | GenBank Protein Acc # | SEQ ID NO: Protein | NAME | Class |
|---|---|---|---|---|---|---|
| PRKAA2 | NM_006252.3 | 27 | NP_006243.2 | 83 | protein kinase, AMP-activated, alpha 2 subunit | Kinase |
| PTGIR | NM_000960.3 | 28 | NP_000951.1 | 84 | prostaglandin I2 (prostacyclin) receptor (IP) | GPCR |
| CACNA1G | NM_018896.4 | 29 | NP_061496.2 | 85 | calcium channel, voltage-dependent, T type, alpha 1G subunit | Ion Channel |
| | NM_198377.2 | 30 | NP_938191.2 | 86 | | |
| | NM_198396.2 | 31 | NP_938406.1 | 87 | | |
| | NM_198385.2 | 32 | NP_938199.1 | 88 | | |
| | NM_198380.2 | 33 | NP_938194.1 | 89 | | |
| | NM_198383.2 | 34 | NP_938197.1 | 90 | | |
| | NM_198379.2 | 35 | NP_938193.1 | 91 | | |
| | NM_198384.2 | 36 | NP_938198.1 | 92 | | |
| | NM_198378.2 | 37 | NP_938192.1 | 93 | | |
| | NM_198386.2 | 38 | NP_938200.1 | 94 | | |
| | NM_198382.2 | 39 | NP_938196.1 | 95 | | |
| | NM_198387.2 | 40 | NP_938201.1 | 96 | | |
| | NM_198388.2 | 41 | NP_938202.1 | 97 | | |
| | NM_198376.2 | 42 | NP_938190.1 | 98 | | |
| | NM_001256324.1 | 43 | NP_001243253.1 | 99 | | |
| | NM_001256325.1 | 44 | NP_001243254.1 | 100 | | |
| | NM_001256326.1 | 45 | NP_001243255.1 | 101 | | |
| | NM_001256327.1 | 46 | NP_001243256.1 | 102 | | |
| | NM_001256328.1 | 47 | NP_001243257.1 | 103 | | |
| | NM_001256329.1 | 48 | NP_001243258.1 | 104 | | |
| | NM_001256330.1 | 49 | NP_001243259.1 | 105 | | |
| | NM_001256331.1 | 50 | NP_001243260.1 | 106 | | |
| | NM_001256332.1 | 51 | NP_001243261.1 | 107 | | |
| | NM_001256333.1 | 52 | NP_001243262.1 | 108 | | |
| | NM_001256334.1 | 53 | NP_001243263.1 | 109 | | |
| | NM_001256359.1 | 54 | NP_001243288.1 | 110 | | |
| | NM_001256360.1 | 55 | NP_001243289.1 | 111 | | |
| | NM_001256361.1 | 56 | NP_001243290.1 | 112 | | |

A particular embodiment of the invention comprises the GPCR TARGETs identified as SEQ ID NO: 57, 58 and 84. A particular embodiment of the invention comprises the kinase TARGETs identified as SEQ ID NO: 60, 61, 62, 63 and 83. A particular embodiment of the invention comprises the protease TARGET identified as SEQ ID NO: 59 and 65. A particular embodiment of the invention comprises the secreted/extracellular TARGETs identified as SEQ ID NO: 64 and 76. A particular embodiment of the invention comprises the transferase TARGETs identified as SEQ ID NO: 66, 77-82. A particular embodiment of the invention comprises the oxidoreductase TARGET identified as SEQ ID NO: 67-70. A particular embodiment of the invention comprises the ion channel TARGETs identified as SEQ ID NO: 71-75, 85-112.

Methods of the Invention

In one aspect, the present invention relates to a method for identifying a compound useful for the treatment of fibrosis, said method comprising:
 a) contacting a test compound with a polypeptide comprising an amino acid sequence selected from the group consisting of SEQ ID NOs: 57-112, fragments and functional derivatives thereof;
 b) measuring a binding affinity of the test compound to said polypeptide;
 c) contacting the test compound with a population of fibroblasts;
 d) measuring a property related to fibroblast migration or differentiation; and
 e) identifying a compound capable of inhibiting fibroblast migration or differentiation and demonstrating binding affinity to said polypeptide.

In further aspect, the present invention relates to a method for identifying a compound that inhibits fibroblast migration and differentiation, said method comprising:
 a) contacting a test compound with a polypeptide comprising an amino acid sequence selected from the group consisting of SEQ ID NOs: 57-112, fragments and functional derivatives thereof;
 b) measuring a binding affinity of the test compound to said polypeptide;
 c) contacting the test compound with a population of fibroblasts;
 d) measuring a property related to fibroblast migration or differentiation; and
 e) identifying a compound capable of inhibiting fibroblast migration or differentiation and demonstrating binding affinity to said polypeptide.

In one aspect, the present invention relates to a method for identifying a compound that inhibits fibroblast migration or differentiation, said method comprising:
 a) contacting a test compound with a polypeptide comprising an amino acid sequence selected from the group consisting of SEQ ID NOs: 57-112, fragments and functional derivatives thereof or with a nucleic acid encoding an amino acid selected from the group consisting of SEQ ID NOs: 57-112 or a functional derivative thereof;
 b) identifying and/or measuring a binding affinity of the test compound to said polypeptide or nucleic acid;

c) contacting the test compound with a population of fibroblasts;
d) measuring a property related to or indicating fibroblast migration or differentiation; and
e) identifying a compound capable of inhibiting or reducing fibroblast migration or differentiation and demonstrating binding affinity to said polypeptide or nucleic acid.

In a further aspect of the above method, the nucleic acid encoding an amino acid selected from the group consisting of SEQ ID NOs: 57-112 or a functional derivative thereof may be selected from the group consisting of SEQ ID NOs: 1-56.

The order of taking these measurements is not believed to be critical to the practice of the present invention, which may be practiced in any order. In a particular aspect the method steps (c) and (d) may be performed before performing steps (a) and (b). For example, one may first perform a screening assay of a set of compounds for which no information is known respecting the compounds' binding affinity for the polypeptide. Alternatively, one may screen a set of compounds identified as having binding affinity for a polypeptide domain, or a class of compounds identified as being an inhibitor of the polypeptide.

In another aspect, steps (a)-(d) method may also be performed simultaneously in a cell-based assay by contacting a test compound with a population of fibroblasts, measuring a binding affinity of the test compound to a TARGET polypeptide and a property related to fibroblast migration or differentiation, and identifying a compound capable of inhibiting fibroblast migration or differentiation and which demonstrates binding affinity to said polypeptide.

The binding affinity of a compound with the polypeptide TARGET can be measured by methods known in the art, such as using surface plasmon resonance biosensors (Biacore®), by saturation binding analysis with a labeled compound (for example, Scatchard and Lindmo analysis), by differential UV spectrophotometer, fluorescence polarization assay, Fluorometric Imaging Plate Reader (FLIPR®) system, Fluorescence resonance energy transfer, and Bioluminescence resonance energy transfer. The binding affinity of compounds can also be expressed in dissociation constant (Kd) or as $IC_{50}$ or $EC_{50}$. The $IC_{50}$ represents the concentration of a compound that is required for 50% inhibition of binding of another ligand to the polypeptide. The $EC_{50}$ represents the concentration required for obtaining 50% of the maximum effect in any assay that measures TARGET function. The dissociation constant, Kd, is a measure of how well a ligand binds to the polypeptide, it is equivalent to the ligand concentration required to saturate exactly half of the binding-sites on the polypeptide. Compounds with a high affinity binding have low Kd, $IC_{50}$ and $EC_{50}$ values, for example, in the range of 100 nM to 1 pM; a moderate- to low-affinity binding relates to high Kd, $IC_{50}$ and $EC_{50}$ values, for example in the micromolar range.

In one aspect, the assay method includes contacting a TARGET polypeptide with a compound that exhibits a binding affinity in the micromolar range. In an aspect, the binding affinity exhibited is at least 10 micromolar. In an aspect, the binding affinity is at least 1 micromolar. In an aspect, the binding affinity is at least 500 nanomolar.

In a particular aspect a test compound is selected based its ability to bind to a TARGET class or from a known libraries of compounds having ability to bind to a TARGET class.

In further aspect, the present invention relates to a method for identifying a compound useful for the treatment of fibrosis, said method comprising:

a) contacting a test compound with a polypeptide comprising an amino acid sequence selected from the group consisting of SEQ ID NOs: 57-112, functional fragments and functional derivatives thereof;
b) measuring an activity of said polypeptide;
c) contacting the test compound with a population of fibroblasts;
d) measuring a property related to fibroblast migration or differentiation; and
e) identifying a compound capable of inhibition of fibroblast migration or differentiation and inhibiting the activity of said polypeptide.

In additional aspect, the present invention relates to a method for identifying a compound that inhibits fibroblast migration and differentiation, said method comprising:

a) contacting a test compound with a polypeptide comprising an amino acid sequence selected from the group consisting of SEQ ID NOs: 57-112, functional fragments and functional derivatives thereof;
b) measuring an activity of said polypeptide;
c) contacting the test compound with a population of fibroblasts;
d) measuring a property related to fibroblast migration or differentiation; and
e) identifying a compound capable of inhibition of fibroblast migration or differentiation and inhibiting the activity of said polypeptide.

In a further aspect, the present invention relates to a method for identifying a compound that inhibits fibroblast migration and differentiation, said method comprising:

a) contacting a test compound with a polypeptide comprising an amino acid sequence selected from the group consisting of SEQ ID NOs: 57-112, functional fragments and functional derivatives thereof or with a nucleic acid encoding an amino acid selected from the group consisting of SEQ ID NOs: 57-112 or a functional derivative thereof;
b) measuring the expression or an activity of said polypeptide;
c) identifying a compound capable of inhibiting the expression or activity of said polypeptide whereby inhibition of expression or activity of said polypeptide results in or is associated with inhibition of fibroblast migration or differentiation.

In an additional aspect of the above method, the nucleic acid encoding an amino acid selected from the group consisting of SEQ ID NOs: 57-112 or a functional derivative thereof may be selected from the group consisting of SEQ ID NOs: 1-56.

It is contemplated that the methods above and further provided herein may be applicable in scarring and/or wound healing and particularly in identifying a compound useful for inhibiting or minimizing scarring and/or for mediating effective wound healing by minimizing excessive or unwarranted scarring of a wound, injury, graft, etc.

The order of taking these measurements is not believed to be critical to the practice of the present invention, which may be practiced in any order. In a particular aspect of the method steps (c) and (d) may be performed before performing steps (a) and (b). For example, one may first perform a screening assay of a set of compounds for which no information is known respecting the compounds' binding affinity for the polypeptide. Alternatively, one may screen a set of compounds identified as having binding affinity for a polypeptide domain, or a class of compounds identified as being an inhibitor of the polypeptide.

Table 1 lists the TARGETS identified using applicants' knock-down library in the fibroblast migration and differentiation assays exemplified herein, including the class of polypeptides identified. TARGETS have been identified in polypeptide classes including kinases, proteases, enzymes, ion channels, GPCRs, and extracellular proteins, for instance. A skilled artisan would be aware of different methods of measuring activity of those classes both in cell-free preparations as well in cell-based assays. A variety of methods exists and might be adapted to a particular target. Those adaptations are a matter of routine experimentation and rely on the existent techniques and methods. Some exemplary methods are described herein.

Ion channels are membrane protein complexes and their function is to facilitate the diffusion of ions across biological membranes. Membranes, or phospholipid bilayers, build a hydrophobic, low dielectric barrier to hydrophilic and charged molecules. Ion channels provide a high conducting, hydrophilic pathway across the hydrophobic interior of the membrane. The activity of an ion channel can be measured using classical patch clamping. High-throughput fluorescence-based or tracer-based assays are also widely available to measure ion channel activity. These fluorescent-based assays screen compounds on the basis of their ability to either open or close an ion channel thereby changing the concentration of specific fluorescent dyes across a membrane. In the case of the tracer-based assay, the changes in concentration of the tracer within and outside the cell are measured by radioactivity measurement or gas absorption spectrometry.

Specific methods to determine the inhibition by the compound by measuring the cleavage of the substrate by the polypeptide, which is a protease, are well known in the art. Classically, substrates are used in which a fluorescent group is linked to a quencher through a peptide sequence that is a substrate that can be cleaved by the target protease. Cleavage of the linker separates the fluorescent group and quencher, giving rise to an increase in fluorescence.

G-protein coupled receptors (GPCR) are capable of activating an effector protein, resulting in changes in second messenger levels in the cell. The TARGETs represented by SEQ ID NO: 57, 58 and 84 are GPCRs. The activity of a GPCR can be measured by measuring the activity level of such second messengers. Two important and useful second messengers in the cell are cyclic AMP (cAMP) and $Ca^{2+}$. The activity levels can be measured by methods known to persons skilled in the art, either directly by ELISA or radioactive technologies or by using substrates that generate a fluorescent or luminescent signal when contacted with $Ca^{2+}$ or indirectly by reporter gene analysis. The activity level of the one or more secondary messengers may typically be determined with a reporter gene controlled by a promoter, wherein the promoter is responsive to the second messenger. Promoters known and used in the art for such purposes are the cyclic-AMP responsive promoter that is responsive for the cyclic-AMP levels in the cell, and the NF-AT responsive promoter that is sensitive to cytoplasmic $Ca^{2+}$-levels in the cell. The reporter gene typically has a gene product that is easily detectable. The reporter gene can either be stably infected or transiently transfected in the host cell. Useful reporter genes are alkaline phosphatase, enhanced green fluorescent protein, destabilized green fluorescent protein, luciferase and β-galactosidase.

In another aspect the present relation relates to a method for identifying a compound useful for the treatment of fibrosis, said method comprising a) contacting a test compound with population of fibroblasts expressing a polypeptide comprising an amino acid sequence selected from the group consisting of SEQ ID NOs: 57-112;
b) measuring expression and/or amount of said polypeptide in said cells;
c) measuring a property related to fibroblast migration of differentiation; and
d) identifying a compound producing reduction of expression and/or amount of said polypeptide and capable of inhibiting fibroblast migration or differentiation In another aspect the present relation relates to a method for identifying a compound that inhibits fibroblast migration and differentiation, said method comprising a) contacting a test compound with population of fibroblasts expressing a polypeptide comprising an amino acid sequence selected from the group consisting of SEQ ID NOs: 57-112;
b) measuring expression and/or amount of said polypeptide in said cells;
c) measuring a property related to fibroblast migration of differentiation; and
d) identifying a compound producing reduction of expression and/or amount of said polypeptide and capable of inhibiting fibroblast migration or differentiation.

In particular aspect the method steps of the invention related to measuring of binding to a TARGET or activity are performed with a population of mammalian cells, in particular human cells, which have been engineered so as to express said TARGET polypeptide. In an alternative aspect the methods of the invention are performed using a population of fibroblasts, which have been engineered so as to express said TARGET polypeptide. This can be achieved by expression of the TARGET polypeptide in the cells using appropriate techniques known to a skilled person. In a specific embodiment, this can be achieved by over-expression of the TARGET polypeptide in the cells using appropriate techniques known to a skilled person. Alternatively, the method of the invention maybe performed with a population of fibroblasts which are known to naturally express said TARGET polypeptide.

In particular aspect the measurements of expression and/or amount of a TARGET polypeptide and a measurement of a property related to fibroblast migration or differentiation can be done in separate steps using different populations of macrophage cells. The order of taking these measurements is not believed to be critical to the practice of the present invention, which may be practiced in any order. For example, the measurements in steps (b) and (c) can also be performed in reverse order. Although, it is sufficient to measure at least one property related to fibroblast migration or differentiation, a skilled person may perform a series of measurements and measure several of said properties.

One particular means of measuring the activity or expression of the polypeptide is to determine the amount of said polypeptide using a polypeptide binding agent, such as an antibody, or to determine the activity of said polypeptide in a biological or biochemical measure, for instance the amount of phosphorylation of a target of a kinase polypeptide.

TARGET gene expression (mRNA levels) can be measured using techniques well-known to a skilled artisan. Particular examples of such techniques include northern analysis or real-time PCR. Those methods are indicative of the presence of nucleic acids encoding TARGETs in a sample, and thereby correlates with expression of the transcript from the polynucleotide.

The population of cells may be exposed to the compound or the mixture of compounds through different means, for instance by direct incubation in the medium, or by nucleic acid transfer into the cells. Such transfer may be achieved by a wide variety of means, for instance by direct transfection of naked isolated DNA, or RNA, or by means of delivery systems, such as recombinant vectors. Other delivery means such as liposomes, or other lipid-based vectors may also be used. Particularly, the nucleic acid compound is delivered by means of a (recombinant) vector such as a recombinant virus.

In vivo animal models of fibrotic diseases may be utilized by the skilled artisan to further or additionally screen, assess, and/or verify the agents or compounds identified in the present invention, including further assessing TARGET modulation in vivo. Such animal models include, but are not limited to bleomycin, irradiation, silica, (inducible) transgenic mouse, FITC and adoptive transfer models for lung fibrosis (Bethany et al, 2008), collagen 4 a3 (COL4A3)-deficiency, nephrotoxic serum nephritis and unilateral ureteral obstruction models for renal fibrosis (Zeisberg et al, 2005) and CCL4 intoxication model for liver fibrosis (Starkel et al, 2011)

A population of fibroblasts in the methods of the invention does not have to be pure or require a particular degree of purity. A population of mammalian cells wherein some of said cells are fibroblasts cells is sufficient to practice the methods of present invention. It should be understood that a population of fibroblasts can be also obtained directly from an organ or alternatively grown using appropriate medium. Fibroblasts can be obtained from commercial vendors like Epithelix or LONZA.

In a specific embodiment the methods may additionally comprise the step of comparing the compound to be tested to a control. Suitable controls should always be in place to insure against false positive readings. In a particular embodiment of the present invention the screening method comprises the additional step of comparing the compound to a suitable control. In one embodiment, the control may be a cell or a sample that has not been in contact with the test compound. In an alternative embodiment, the control may be a cell that does not express the TARGET; for example in one aspect of such an embodiment the test cell may naturally express the TARGET and the control cell may have been contacted with an agent, e.g. a siRNA, which inhibits or prevents expression of the TARGET. Alternatively, in another aspect of such an embodiment, the cell in its native state does not express the TARGET and the test cell has been engineered so as to express the TARGET, so that in this embodiment, the control could be the untransformed native cell. The control may also alternatively utilize either a known inhibitor of fibroblasts migration or differentiation, or a compound known not to have any significant effect on fibroblasts migration or differentiation. Whilst exemplary controls are described herein, this should not be taken as limiting; it is within the scope of a person of skill in the art to select appropriate controls for the experimental conditions being used.

Examples of negative controls include, but not limited to, cells that have been not treated with any compound, cells treated with a compound known not to be an inhibitor of fibroblast migration or differentiation, compounds known not to interfere with the pathways involved in fibroblast migration or differentiation. Examples of positive controls include, but not limited to, cells contacted with compounds known to inhibit activity or expression of CXCR4, COL1A1, PIK3C3, PGK and MAPK14, cells contacted with a compound known to inhibit fibroblast migration or differentiation.

In a particular embodiment the binding and activity testing methods are performed in an in vitro cell-free preparation.

In an alternative embodiment the binding and activity testing in the invention methods is performed in a cell.

In a particular aspect the invention methods activity and binding testing is performed in a mammalian cell. More specifically these steps are performed in fibroblasts. In particular embodiment these steps are performed in human lung fibroblasts. In a specific aspect of the invention the methods are performed with a population of mammalian cells present in a monolayer, preferably said mammalian cells are fibroblasts and more preferably said mammalian cells are human lung fibroblasts.

It should be understood that the cells expressing the polypeptides, may be cells naturally expressing the polypeptides, or the cells may be may be transfected to express the polypeptides. Also, the cells may be transduced to overexpress the polypeptide, or may be transfected to express a non-endogenous form of the polypeptide, which can be differentially assayed or assessed.

The polynucleotide expressing the TARGET polypeptide in cells might be included within a vector. The polynucleic acid is operably linked to signals enabling expression of the nucleic acid sequence and is introduced into a cell utilizing, particularly, recombinant vector constructs, which will express the nucleic acid once the vector is introduced into the cell. A variety of viral-based systems are available, including adenoviral, retroviral, adeno-associated viral, lentiviral, herpes simplex viral or a sendai viral vector systems. All may be used to introduce and express expressing a TARGET polypeptide in the target cells.

In further aspect, the methods of the invention involve measurement of a property is related to fibroblast migration. There are different ways to measure fibroblast migration. In particular aspect such property is a measure of scratch in a monolayer of fibroblasts. Furthermore, also transwell system/Boyden Chamber assays and time-lapse experiments can be used to measure fibroblast migration.

In a specific embodiment the methods of the invention utilize cells that have been triggered by a factor which induces fibroblast migration (migration-inducing factor). Many of such factors have been described in literature and they are well-known to a skilled person. In a particular embodiment the methods of the invention utilize cells that have been triggered by one or more migration-inducing factors selected from the group consisting of is selected from the group consisting of CCLs (CCL3, CCL7, CCL13, CCL27, CCL22, CCL21, CCL15, CCL17, CCL18, CCL19, CCL20), CXCLs (CXCL1, CXCL8, CXCL12), IL13, CTGF, PDGF-BB. In more specific embodiment the methods of the invention utilize cells that have been triggered by PDGF-BB. In specific aspect the cells are triggered by a migration-inducing factor and serum.

In another embodiment the assay methods of the invention involve measurement of a property related to the differentiation of fibroblasts into myofibroblasts.

In a particular embodiment the assay methods of the invention involve measurement of a decrease in production and/or expression of a marker of fibroblast-to-myofibroblast differentiation.

Many of the fibroblast differentiation markers are known to a skilled person. The selection of such markers depends on the availability of reagents, scale of the practiced assay methods and other factors related to a specific assay design. In a specific embodiment fibroblast differentiation marker is selected from the group consisting of α-smooth muscle actin, collagens, and connective tissue growth factor. In a specific embodiment the said marker is α-smooth muscle actin.

In a particular embodiment the methods of the invention utilize cells that have been triggered by a fibroblast-to-myofibroblast differentiation factor. In a specific embodiment said fibroblast-to-myofibroblast differentiation factor is TGFβ.

The means of measuring differentiation markers, depending on the assay setup and throughput, are known to a skilled artisan. Although human ELISA's are commercially available their sensitivity is not always able to detect low levels of the markers. Therefore, the assay might be optimized on the Meso Scale Discovery platform (MSD) (Meso Scale Discovery, Maryland, U.S.) as a sandwich immunoassay where signaling molecules are specifically captured and detected by antibodies. MSD technology uses micro-plates with carbon electrodes integrated at the bottom of the plates; Biological reagents, immobilized to the carbon simply by passive adsorption, retain high biological activity. MSD assays use electro-chemiluminescent labels for ultra-sensitive detection. The detection process is initiated at electrodes located at the bottom of the micro-plates. Labels near the electrode only are excited and detected reducing background signal. The antibodies for such assay might be purchased from different producers and the skilled artisan is in the position to choose correct antibodies to perform the assay.

Alternatively the expression levels of fibroblast differentiation markers can be measured using known methods including quantitative real time polymerase chain reaction (Q-PCR/qPCR/qrt-PCR). qPCR is a laboratory technique based on the PCR, which is used to amplify and simultaneously quantify a targeted DNA molecule. For one or more specific sequences in a DNA sample, Real Time-PCR enables both detection and quantification. The quantity can be either an absolute number of copies or a relative amount when normalized to DNA input or additional normalizing genes.

Candidate Compounds

Expression-Inhibiting Agents

A particular embodiment the methods of the invention a test compound is selected from the group consisting of an antisense polynucleotide, a ribozyme, short-hairpin RNA (shRNA), microRNA (miRNA) and a small interfering RNA (siRNA).

A special embodiment of these methods comprises an expression-inhibitory agent selected from the group consisting of antisense RNA, antisense oligodeoxynucleotide (ODN), a ribozyme that cleaves the polyribonucleotide coding for SEQ ID NO: 57-112, a small interfering RNA (siRNA) or microRNA (miRNA) that is sufficiently homologous to a portion of the polyribonucleotide corresponding to SEQ ID NO: 1-56, such that the siRNA interferes with the translation of the TARGET polyribonucleotide to the TARGET polypeptide.

The down regulation of gene expression using antisense nucleic acids can be achieved at the translational or transcriptional level. Antisense nucleic acids of the invention are particularly nucleic acid fragments capable of specifically hybridizing with all or part of a nucleic acid encoding a TARGET polypeptide or the corresponding messenger RNA. In addition, antisense nucleic acids may be designed which decrease expression of the nucleic acid sequence capable of encoding a TARGET polypeptide by inhibiting splicing of its primary transcript. Any length of antisense sequence is suitable for practice of the invention so long as it is capable of down-regulating or blocking expression of a nucleic acid coding for a TARGET. Particularly, the antisense sequence is at least about 15-30, and particularly at least 17 nucleotides in length. The preparation and use of antisense nucleic acids, DNA encoding antisense RNAs and the use of oligo and genetic antisense is known in the art.

In a more specific embodiment a test compound comprises a nucleic acid sequence complementary to, or engineered from, a naturally-occurring polynucleotide sequence of about 17 to about 30 contiguous nucleotides of a TARGET polynucleotide.

The skilled artisan can readily utilize any of several strategies to facilitate and simplify the selection process for antisense nucleic acids and oligonucleotides effective in inhibition of TARGET and differentiation of macrophages into alternatively-activated macrophages. Predictions of the binding energy or calculation of thermodynamic indices between an oligonucleotide and a complementary sequence in an mRNA molecule may be utilized (Chiang et al. (1991) J. Biol. Chem. 266:18162-18171; Stull et al. (1992) Nucl. Acids Res. 20:3501-3508). Antisense oligonucleotides may be selected on the basis of secondary structure (Wickstrom et al (1991) in Prospects for Antisense Nucleic Acid Therapy of Cancer and AIDS, Wickstrom, ed., Wiley-Liss, Inc., New York, pp. 7-24; Lima et al. (1992) Biochem. 31:12055-12061). Schmidt and Thompson (U.S. Pat. No. 6,416,951) describe a method for identifying a functional antisense agent comprising hybridizing an RNA with an oligonucleotide and measuring in real time the kinetics of hybridization by hybridizing in the presence of an intercalation dye or incorporating a label and measuring the spectroscopic properties of the dye or the label's signal in the presence of unlabelled oligonucleotide. In addition, any of a variety of computer programs may be utilized which predict suitable antisense oligonucleotide sequences or antisense targets utilizing various criteria recognized by the skilled artisan, including for example the absence of self-complementarity, the absence of hairpin loops, the absence of stable homodimer and duplex formation (stability being assessed by predicted energy in kcal/mol). Examples of such computer programs are readily available and known to the skilled artisan and include the OLIGO 4 or OLIGO 6 program (Molecular Biology Insights, Inc., Cascade, Colo.) and the Oligo Tech program (Oligo Therapeutics Inc., Wilsonville, Oreg.). In addition, antisense oligonucleotides suitable in the present invention may be identified by screening an oligonucleotide library, or a library of nucleic acid molecules, under hybridization conditions and selecting for those which hybridize to the target RNA or nucleic acid (see for example U.S. Pat. No. 6,500,615). Mishra and Toulme have also developed a selection procedure based on selective amplification of oligonucleotides that bind target (Mishra et al (1994) Life Sciences 317:977-982). Oligonucleotides may also be selected by their ability to mediate cleavage of target RNA by RNAse H, by selection and characterization of the cleavage fragments (Ho et al (1996) Nucl Acids Res 24:1901-1907; Ho et al (1998) Nature Biotechnology 16:59-630). Generation and targeting of oligonucleotides to GGGA motifs of RNA molecules has also been described (U.S. Pat. No. 6,277,981).

The antisense nucleic acids are particularly oligonucleotides and may consist entirely of deoxyribo-nucleotides, modified deoxyribonucleotides, or some combination of both. The antisense nucleic acids can be synthetic oligonucleotides. The oligonucleotides may be chemically modified, if desired, to improve stability and/or selectivity. Specific examples of some particular oligonucleotides envisioned for this invention include those containing modified backbones, for example, phosphorothioates, phosphotriesters, methyl phosphonates, short chain alkyl or cycloalkyl intersugar linkages or short chain heteroatomic or heterocyclic intersugar linkages. Since oligonucleotides are susceptible to degradation by intracellular nucleases, the modifications can include, for example, the use of a sulfur group to replace the free oxygen of the phosphodiester bond. This modification is called a phosphorothioate linkage. Phosphorothioate antisense oligonucleotides are water soluble, polyanionic, and resistant to endogenous nucleases. In addition, when a phosphorothioate antisense oligonucleotide hybridizes to its TARGET site, the RNA-DNA duplex activates the endogenous enzyme ribonuclease (RNase) H, which cleaves the mRNA component of the hybrid molecule. Oligonucleotides may also contain one or more substituted sugar moieties. Particular oligonucleotides comprise one of the following at the 2' position: OH, SH, SCH3, F, OCN, heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. Similar modifications may also be made at other positions on the oligonucleotide, particularly the 3' position of the sugar on the 3' terminal nucleotide and the 5' position of 5' terminal nucleotide.

In addition, antisense oligonucleotides with phosphoramidite and polyamide (peptide) linkages can be synthesized. These molecules should be very resistant to nuclease degradation. Furthermore, chemical groups can be added to the 2' carbon of the sugar moiety and the 5 carbon (C-5) of pyrimidines to enhance stability and facilitate the binding of the antisense oligonucleotide to its TARGET site. Modifications may include 2'-deoxy, O-pentoxy, O-propoxy, O-methoxy, fluoro, methoxyethoxy phosphorothioates, modified bases, as well as other modifications known to those of skill in the art.

Another type of expression-inhibitory agent that reduces the levels of TARGETS is the ribozyme. Ribozymes are catalytic RNA molecules (RNA enzymes) that have separate catalytic and substrate binding domains. The substrate binding sequence combines by nucleotide complementarity and, possibly, non-hydrogen bond interactions with its TARGET sequence. The catalytic portion cleaves the TARGET RNA at a specific site. The substrate domain of a ribozyme can be engineered to direct it to a specified mRNA sequence. The ribozyme recognizes and then binds a TARGET mRNA through complementary base pairing. Once it is bound to the correct TARGET site, the ribozyme acts enzymatically to cut the TARGET mRNA. Cleavage of the mRNA by a ribozyme destroys its ability to direct synthesis of the corresponding polypeptide. Once the ribozyme has cleaved its TARGET sequence, it is released and can repeatedly bind and cleave at other mRNAs.

Exemplary ribozyme forms include a hammerhead motif, a hairpin motif, a hepatitis delta virus, group I intron or RNaseP RNA (in association with an RNA guide sequence) motif or Neurospora VS RNA motif Ribozymes possessing a hammerhead or hairpin structure are readily prepared since these catalytic RNA molecules can be expressed within cells from eukaryotic promoters (Chen, et al. (1992) Nucleic Acids Res. 20:4581-9). A ribozyme of the present invention can be expressed in eukaryotic cells from the appropriate DNA vector. If desired, the activity of the ribozyme may be augmented by its release from the primary transcript by a second ribozyme (Ventura, et al. (1993) Nucleic Acids Res. 21:3249-55).

Ribozymes may be chemically synthesized by combining an oligodeoxyribonucleotide with a ribozyme catalytic domain (20 nucleotides) flanked by sequences that hybridize to the TARGET mRNA after transcription. The oligodeoxyribonucleotide is amplified by using the substrate binding sequences as primers. The amplification product is cloned into a eukaryotic expression vector.

Ribozymes are expressed from transcription units inserted into DNA, RNA, or viral vectors. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on nearby gene regulatory sequences. Prokaryotic RNA polymerase promoters are also used, providing that the prokaryotic RNA polymerase enzyme is expressed in the appropriate cells (Gao and Huang, (1993) Nucleic Acids Res. 21:2867-72). It has been demonstrated that ribozymes expressed from these promoters can function in mammalian cells (Kashani-Sabet, et al. (1992) Antisense Res. Dev. 2:3-15).

In a particular embodiment the methods of the invention might be practiced using antisense polynucleotide, siRNA or shRNA comprising an antisense strand of 17-25 nucleotides complementary to a sense strand, wherein said sense strand is selected from 17-25 continuous nucleotides of a TARGET polynucleotide.

A particular inhibitory agent is a small interfering RNA (siRNA, particularly small hairpin RNA, "shRNA"). siRNA, particularly shRNA, mediate the post-transcriptional process of gene silencing by double stranded RNA (dsRNA) that is homologous in sequence to the silenced RNA. siRNA according to the present invention comprises a sense strand of 15-30, particularly 17-30, most particularly 17-25 nucleotides complementary or homologous to a contiguous 17-25 nucleotide sequence selected from the group of sequences described in SEQ ID NO: 1-56, particularly from the group of sequences described in SEQ ID NOs: 129-171, and an antisense strand of 15-30, particularly 17-30, most particularly 17-25, more specifically 19-21 nucleotides complementary to the sense strand. More particular siRNA according to the present invention comprises a sense strand selected from the group of sequences comprising SEQ ID NOs: 129-171. The most particular siRNA comprises sense and anti-sense strands that are 100 percent complementary to each other and the TARGET polynucleotide sequence. Particularly the siRNA further comprises a loop region linking the sense and the antisense strand.

A self-complementing single stranded shRNA molecule polynucleotide according to the present invention comprises a sense portion and an antisense portion connected by a loop region linker. Particularly, the loop region sequence is 4-30 nucleotides long, more particularly 5-15 nucleotides long and most particularly 8 or 12 nucleotides long. In a most particular embodiment the linker sequence is UUGCUAUA or GUUUGCUAUAAC (SEQ ID NO: 172). Self-complementary single stranded siRNAs form hairpin loops and are more stable than ordinary dsRNA. In addition, they are more easily produced from vectors.

Analogous to antisense RNA, the siRNA can be modified to confirm resistance to nucleolytic degradation, or to enhance activity, or to enhance cellular distribution, or to enhance cellular uptake, such modifications may consist of modified internucleoside linkages, modified nucleic acid bases, modified sugars and/or chemical linkage the siRNA to one or more moieties or conjugates. The nucleotide sequences are selected according to siRNA designing rules that give an improved reduction of the TARGET sequences compared to nucleotide sequences that do not comply with these siRNA designing rules (For a discussion of these rules and examples of the preparation of siRNA, WO 2004/094636 and US 2003/0198627, are hereby incorporated by reference).

Particular inhibitory agents include MicroRNAs (referred to as "miRNAs"). miRNA are small non-coding RNAs, belonging to a class of regulatory molecules found in many eukaryotic species that control gene expression by binding to complementary sites on target messenger RNA (mRNA) transcripts.

In vivo miRNAs are generated from larger RNA precursors (termed pri-miRNAs) that are processed in the nucleus into approximately 70 nucleotide pre-miRNAs, which fold into imperfect stem-loop structures. The pre-miRNAs undergo an additional processing step within the cytoplasm where mature miRNAs of 18-25 nucleotides in length are excised from one side of the pre-miRNA hairpin by an RNase III enzyme.

miRNAs have been shown to regulate gene expression in two ways. First, miRNAs binding to protein-coding mRNA sequences that are exactly complementary to the miRNA induce the RNA-mediated interference (RNAi) pathway. Messenger RNA targets are cleaved by ribonucleases in the RISC complex. In the second mechanism, miRNAs that bind to imperfect complementary sites on messenger RNA transcripts direct gene regulation at the posttranscriptional level but do not cleave their mRNA targets. miRNAs identified in both plants and animals use this mechanism to exert translational control over their gene targets.

Low Molecular Weight Compounds

Particular drug candidate compounds are low molecular weight compounds. Low molecular weight compounds, for example with a molecular weight of 500 Dalton or less, are likely to have good absorption and permeation in biological systems and are consequently more likely to be successful drug candidates than compounds with a molecular weight above 500 Dalton (Lipinski et al., 2001)). Peptides comprise another particular class of drug candidate compounds. Peptides may be excellent drug candidates and there are multiple examples of commercially valuable peptides such as fertility hormones and platelet aggregation inhibitors. Natural compounds are another particular class of drug candidate compound. Such compounds are found in and extracted from natural sources, and which may thereafter be synthesized. The lipids are another particular class of drug candidate compound.

Antibodies

Another preferred class of drug candidate compounds is an antibody. The present invention also provides antibodies directed against the TARGETS. These antibodies may be endogenously produced to bind to the TARGETS within the cell, or added to the tissue to bind to the TARGET polypeptide present outside the cell. These antibodies may be monoclonal antibodies or polyclonal antibodies. The present invention includes chimeric, single chain, and humanized antibodies, as well as FAb fragments and the products of a FAb expression library, and Fv fragments and the products of an Fv expression library.

In certain embodiments, polyclonal antibodies may be used in the practice of the invention. The skilled artisan knows methods of preparing polyclonal antibodies. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. Antibodies may also be generated against the intact TARGET protein or polypeptide, or against a fragment, derivatives including conjugates, or other epitope of the TARGET protein or polypeptide, such as the TARGET embedded in a cellular membrane, or a library of antibody variable regions, such as a phage display library.

It may be useful to conjugate the immunizing agent to a protein known to be immunogenic in the mammal being immunized Examples of such immunogenic proteins include but are not limited to keyhole limpet hemocyanin, serum albumin, bovine thyroglobulin, and soybean trypsin inhibitor. Examples of adjuvants that may be employed include Freund's complete adjuvant and MPL-TDM adjuvant (monophosphoryl Lipid A, synthetic trehalose dicorynomycolate). One skilled in the art without undue experimentation may select the immunization protocol.

In some embodiments, the antibodies may be monoclonal antibodies. Monoclonal antibodies may be prepared using methods known in the art. The monoclonal antibodies of the present invention may be "humanized" to prevent the host from mounting an immune response to the antibodies. A "humanized antibody" is one in which the complementarity determining regions (CDRs) and/or other portions of the light and/or heavy variable domain framework are derived from a non-human immunoglobulin, but the remaining portions of the molecule are derived from one or more human immunoglobulins. Humanized antibodies also include antibodies characterized by a humanized heavy chain associated with a donor or acceptor unmodified light chain or a chimeric light chain, or vice versa. The humanization of antibodies may be accomplished by methods known in the art (see, e.g. Mark and Padlan, (1994) "Chapter 4. Humanization of Monoclonal Antibodies", The Handbook of Experimental Pharmacology Vol. 113, Springer-Verlag, New York). Transgenic animals may be used to express humanized antibodies.

Human antibodies can also be produced using various techniques known in the art, including phage display libraries (Hoogenboom and Winter, (1991) J. Mol. Biol. 227:381-8; Marks et al. (1991). J. Mol. Biol. 222:581-97). The techniques of Cole, et al. and Boerner, et al. are also available for the preparation of human monoclonal antibodies (Cole, et al. (1985) Monoclonal Antibodies and Cancer Therapy, Alan R. Liss, p. 77; Boerner, et al (1991). J. Immunol., 147(1):86-95).

Techniques known in the art for the production of single chain antibodies can be adapted to produce single chain antibodies to the TARGETS. The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain cross-linking. Alternatively; the relevant cysteine residues are substituted with another amino acid residue or are deleted so as to prevent cross-linking.

Bispecific antibodies are monoclonal, preferably human or humanized, antibodies that have binding specificities for at least two different antigens and preferably for a cell-surface protein or receptor or receptor subunit. In the present case, one of the binding specificities is for one domain of the TARGET; the other one is for another domain of the TARGET.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, (1983) Nature 305:537-9). Because of the random assortment of immunoglobulin heavy and light chains, these hybridomas (quadromas) produce a potential mixture of ten different antibody molecules, of which only one has the correct bispecific structure. Affinity chromatography steps usually accomplish the purification of the correct molecule. Similar procedures are disclosed in Trauneeker, et al. (1991) EMBO J. 10:3655-9.

A special aspect of the methods of the present invention relates to the down-regulation or blocking of the expression of a TARGET polypeptide by the induced expression of a polynucleotide encoding an intracellular binding protein that is capable of selectively interacting with the TARGET polypeptide. An intracellular binding protein includes an activity-inhibitory agent and any protein capable of selectively interacting, or binding, with the polypeptide in the cell in which it is expressed and neutralizing the function of the polypeptide. Particularly, the intracellular binding protein may be an antibody, particularly a neutralizing antibody, or a fragment of an antibody or neutralizing antibody having binding affinity to an epitope of the TARGET polypeptide of SEQ ID NO: 57-112. More particularly, the intracellular binding protein is a single chain antibody.

Pharmaceutical Compositions, Related Uses and Methods

The antibodies or a fragments thereof which specifically bind to a TARGET polypeptide and expression inhibiting agents selected from the group consisting of an antisense polynucleotide, a ribozyme, a small interfering RNA (siRNA), microRNA (miRNA) and a short-hairpin RNA (shRNA) that may be used as therapeutic agents for the treatment of conditions in mammals that are causally related or attributable to fibroblast migration and differentiation.

The present invention relates to pharmaceutical compositions comprising an antibody or a fragment thereof which specifically binds to a TARGET polypeptide, for use in the treatment of a fibrotic condition. In a particular embodiment a fibrotic condition is a fibrotic condition associated with fibroblast migration and differentiation.

In particular aspect, the present invention provides a method of treating a mammal having, or at risk of having a fibrotic disease, said method comprising administering an effective condition-treating or condition-preventing amount of one or more of the pharmaceutical compositions comprising an antibody or a fragment thereof which specifically binds to a TARGET polypeptide. In a particular aspect, the present invention provides a method of treating a mammal having, or at risk of having idiopathic pulmonary fibrosis (IPF), cystic fibrosis, other diffuse parenchymal lung diseases of different etiologies including iatrogenic drug-induced fibrosis, occupational and/or environmental induced fibrosis, granulomatous diseases (sarcoidosis, hypersensitivity pneumonia), collagen vascular disease, alveolar proteinosis, langerhans cell granulomatosis, lymphangioleiomyomatosis, inherited diseases (Hermansky-Pudlak Syndrome, tuberous sclerosis, neurofibromatosis, metabolic storage disorders, familial interstitial lung disease), radiation induced fibrosis, chronic obstructive pulmonary disease (COPD), scleroderma, bleomycin induced pulmonary fibrosis, chronic asthma, silicosis, asbestos induced pulmonary fibrosis, acute respiratory distress syndrome (ARDS), kidney fibrosis, tubulointerstitium fibrosis, glomerular nephritis, focal segmental glomerular sclerosis, IgA nephropathy, hypertension, Alport syndrome, gut fibrosis, liver fibrosis, cirrhosis, alcohol induced liver fibrosis, toxic/drug induced liver fibrosis, hemochromatosis, nonalcoholic steatohepatitis (NASH), biliary duct injury, primary biliary cirrhosis, infection induced liver fibrosis, viral induced liver fibrosis, autoimmune hepatitis, corneal scarring, hypertrophic scarring, Dupuytren disease, keloids, cutaneous fibrosis, cutaneous scleroderma, systemic sclerosis, spinal cord injury/fibrosis, myelofibrosis, vascular restenosis, atherosclerosis, arteriosclerosis, Wegener's granulomatosis, Peyronie's disease, and/or diseases associated with fibroblast migration and differentiation. In specific embodiment, said antibody is a monoclonal antibody. In alternative embodiment said antibody is a single chain antibody. In particular embodiment said fibrotic condition is a fibrotic condition associated with fibroblast migration and differentiation.

In another aspect the present invention provides an antibody or a fragment thereof which specifically binds to a TARGET polypeptide for use in the treatment, and/or prophylaxis of a fibrotic condition. In a specific embodiment, said fibrotic condition is selected from idiopathic pulmonary fibrosis (IPF), cystic fibrosis, other diffuse parenchymal lung diseases of different etiologies including iatrogenic drug-induced fibrosis, occupational and/or environmental induced fibrosis, granulomatous diseases (sarcoidosis, hypersensitivity pneumonia), collagen vascular disease, alveolar proteinosis, langerhans cell granulomatosis, lymphangioleiomyomatosis, inherited diseases (Hermansky-Pudlak Syndrome, tuberous sclerosis, neurofibromatosis, metabolic storage disorders, familial interstitial lung disease), radiation induced fibrosis, chronic obstructive pulmonary disease (COPD), scleroderma, bleomycin induced pulmonary fibrosis, chronic asthma, silicosis, asbestos induced pulmonary fibrosis, acute respiratory distress syndrome (ARDS), kidney fibrosis, tubulointerstitium fibrosis, glomerular nephritis, focal segmental glomerular sclerosis, IgA nephropathy, hypertension, Alport syndrome, gut fibrosis, liver fibrosis, cirrhosis, alcohol induced liver fibrosis, toxic/drug induced liver fibrosis, hemochromatosis, nonalcoholic steatohepatitis (NASH), biliary duct injury, primary biliary cirrhosis, infection induced liver fibrosis, viral induced liver fibrosis, autoimmune hepatitis, corneal scarring, hypertrophic scarring, Dupuytren disease, keloids, cutaneous fibrosis, cutaneous scleroderma, systemic sclerosis, spinal cord injury/fibrosis, myelofibrosis, vascular restenosis, atherosclerosis, arteriosclerosis, Wegener's granulomatosis, Peyronie's disease, and/or diseases associated with fibroblast migration and differentiation. In specific embodiment, said antibody is a monoclonal antibody. In alternative embodiment said antibody is a single chain antibody. In particular embodiment said fibrotic condition is a fibrotic condition associated with fibroblast migration and differentiation.

In yet another aspect, the present invention provides an antibody or a fragment thereof which specifically binds to a TARGET polypeptide, or a pharmaceutical composition comprising an antibody or a fragment thereof which specifically binds to a TARGET polypeptide for use in the manufacture of a medicament for the treatment, or prophylaxis of a fibrotic condition. In a specific embodiment, said fibrotic condition is selected from idiopathic pulmonary fibrosis (IPF), cystic fibrosis, other diffuse parenchymal lung diseases of different etiologies including iatrogenic drug-induced fibrosis, occupational and/or environmental induced fibrosis, granulomatous diseases (sarcoidosis, hypersensitivity pneumonia), collagen vascular disease, alveolar proteinosis, langerhans cell granulomatosis, lymphangioleiomyomatosis, inherited diseases (Hermansky-Pudlak Syndrome, tuberous sclerosis, neurofibromatosis, metabolic storage disorders, familial interstitial lung disease), radiation induced fibrosis, chronic obstructive pulmonary disease (COPD), scleroderma, bleomycin induced pulmonary fibrosis, chronic asthma, silicosis, asbestos induced pulmonary fibrosis, acute respiratory distress syndrome (ARDS), kidney fibrosis, tubulointerstitium fibrosis, glomerular nephritis, focal segmental glomerular sclerosis, IgA nephropathy, hypertension, Alport syndrome, gut fibrosis, liver fibrosis, cirrhosis, alcohol induced liver fibrosis, toxic/drug induced liver fibrosis, hemochromatosis, nonalcoholic steatohepatitis (NASH), biliary duct injury, primary biliary cirrhosis, infection induced liver fibrosis, viral induced liver fibrosis, autoimmune hepatitis, corneal scarring, hypertrophic scarring, Dupuytren disease, keloids, cutaneous fibrosis, cutaneous scleroderma, systemic sclerosis, spinal cord injury/fibrosis, myelofibrosis, vascular restenosis, atherosclerosis, arteriosclerosis, Wegener's granulomatosis, Peyronie's disease, and/or diseases associated with fibroblast migration and differentiation. In specific embodiment, said antibody is a monoclonal antibody. In alternative embodiment said antibody is a single chain antibody. In particular embodiment said fibrotic condition is a fibrotic condition associated with fibroblast migration and differentiation.

A particular regimen of the present method comprises the administration to a subject suffering from a fibrotic disease involving fibroblast migration and differentiation, of an effective amount of an antibody or a fragment thereof which specifically binds to a TARGET polypeptide for a period of time sufficient to reduce the level of abnormal fibrosis in the subject, and preferably terminate the processes responsible for said fibrotic condition. A special embodiment of the method comprises administering of an effective amount of an antibody or a fragment thereof which specifically binds to a TARGET polypeptide to a subject patient suffering from or susceptible to the development of a fibrotic disease, for a period of time sufficient to reduce or prevent, respectively, fibrotic condition in said patient, and preferably terminate, the processes responsible for said fibrotic condition. In specific embodiment, said antibody is a monoclonal antibody. In alternative embodiment said antibody is a single chain antibody. In particular embodiment said fibrotic condition is a fibrotic condition associated with fibroblast migration and differentiation.

The present invention further relates to compositions comprising said agents, wherein said agent is selected from the group consisting of an antisense polynucleotide, a ribozyme, a small interfering RNA (siRNA), microRNA (miRNA), and a short-hairpin RNA (shRNA), wherein said agent comprises a nucleic acid sequence complementary to, or engineered from, a naturally-occurring polynucleotide sequence of about 17 to about 30 contiguous nucleotides of a nucleic acid sequence selected from the group consisting of SEQ ID NO: 1-56. These agents are, otherwise, referred herein to as expression inhibitory agents.

In particular aspect, the present invention provides a method of treating a mammal having, or at risk of having a fibrotic disease, said method comprising administering an effective condition-treating or condition-preventing amount of one or more of the pharmaceutical compositions comprising said expression inhibitory agent. In a particular aspect, the present invention provides a method of treating a mammal having, or at risk of having idiopathic pulmonary fibrosis (IPF), cystic fibrosis, other diffuse parenchymal lung diseases of different etiologies including iatrogenic drug-induced fibrosis, occupational and/or environmental induced fibrosis, granulomatous diseases (sarcoidosis, hypersensitivity pneumonia), collagen vascular disease, alveolar proteinosis, langerhans cell granulomatosis, lymphangioleiomyomatosis, inherited diseases (Hermansky-Pudlak Syndrome, tuberous sclerosis, neurofibromatosis, metabolic storage disorders, familial interstitial lung disease), radiation induced fibrosis, chronic obstructive pulmonary disease (COPD), scleroderma, bleomycin induced pulmonary fibrosis, chronic asthma, silicosis, asbestos induced pulmonary fibrosis, acute respiratory distress syndrome (ARDS), kidney fibrosis, tubulointerstitium fibrosis, glomerular nephritis, focal segmental glomerular sclerosis, IgA nephropathy, hypertension, Alport syndrome, gut fibrosis, liver fibrosis, cirrhosis, alcohol induced liver fibrosis, toxic/drug induced liver fibrosis, hemochromatosis, nonalcoholic steatohepatitis (NASH), biliary duct injury, primary biliary cirrhosis, infection induced liver fibrosis, viral induced liver fibrosis, autoimmune hepatitis, corneal scarring, hypertrophic scarring, Dupuytren disease, keloids, cutaneous fibrosis, cutaneous scleroderma, systemic sclerosis, spinal cord injury/fibrosis, myelofibrosis, vascular restenosis, atherosclerosis, arteriosclerosis, Wegener's granulomatosis, Peyronie's disease, and/or diseases associated with fibroblast migration and differentiation. In particular embodiment said fibrotic condition is a fibrotic condition associated with fibroblast migration and differentiation.

In another aspect the present invention provides expression inhibitory agents for use in the treatment, and/or prophylaxis of a fibrotic condition. In a specific embodiment, said fibrotic condition is selected from idiopathic pulmonary fibrosis (IPF), cystic fibrosis, other diffuse parenchymal lung diseases of different etiologies including iatrogenic drug-induced fibrosis, occupational and/or environmental induced fibrosis, granulomatous diseases (sarcoidosis, hypersensitivity pneumonia), collagen vascular disease, alveolar proteinosis, langerhans cell granulomatosis, lymphangioleiomyomatosis, inherited diseases (Hermansky-Pudlak Syndrome, tuberous sclerosis, neurofibromatosis, metabolic storage disorders, familial interstitial lung disease), radiation induced fibrosis, chronic obstructive pulmonary disease (COPD), scleroderma, bleomycin induced pulmonary fibrosis, chronic asthma, silicosis, asbestos induced pulmonary fibrosis, acute respiratory distress syndrome (ARDS), kidney fibrosis, tubulointerstitium fibrosis, glomerular nephritis, focal segmental glomerular sclerosis, IgA nephropathy, hypertension, Alport syndrome, gut fibrosis, liver fibrosis, cirrhosis, alcohol induced liver fibrosis, toxic/drug induced liver fibrosis, hemochromatosis, nonalcoholic steatohepatitis (NASH), biliary duct injury, primary biliary cirrhosis, infection induced liver fibrosis, viral induced liver fibrosis, autoimmune hepatitis, corneal scarring, hypertrophic scarring, Dupuytren disease, keloids, cutaneous fibrosis, cutaneous scleroderma, systemic sclerosis, spinal cord injury/fibrosis, myelofibrosis, vascular restenosis, atherosclerosis, arteriosclerosis, Wegener's granulomatosis, Peyronie's disease, and/or diseases associated with fibroblast migration and differentiation. In particular embodiment said fibrotic condition is a fibrotic condition associated with fibroblast migration and differentiation.

In yet another aspect, the present invention provides expression inhibitory agents, or a pharmaceutical composition comprising said expression inhibitory agents for use in the manufacture of a medicament for the treatment, or prophylaxis of a fibrotic condition. In a specific embodiment, said fibrotic condition is selected from idiopathic pulmonary fibrosis (IPF), cystic fibrosis, other diffuse parenchymal lung diseases of different etiologies including iatrogenic drug-induced fibrosis, occupational and/or environmental induced fibrosis, granulomatous diseases (sarcoidosis, hypersensitivity pneumonia), collagen vascular disease, alveolar proteinosis, langerhans cell granulomatosis, lymphangioleiomyomatosis, inherited diseases (Hermansky-Pudlak Syndrome, tuberous sclerosis, neurofibromatosis, metabolic storage disorders, familial interstitial lung disease), radiation induced fibrosis, chronic obstructive pulmonary disease (COPD), scleroderma, bleomycin induced pulmonary fibrosis, chronic asthma, silicosis, asbestos induced pulmonary fibrosis, acute respiratory distress syndrome (ARDS), kidney fibrosis, tubulointerstitium fibrosis, glomerular nephritis, focal segmental glomerular sclerosis, IgA nephropathy, hypertension, Alport syndrome, gut fibrosis, liver fibrosis, cirrhosis, alcohol induced liver fibrosis, toxic/drug induced liver fibrosis, hemochromatosis, non-alcoholic steatohepatitis (NASH), biliary duct injury, primary biliary cirrhosis, infection induced liver fibrosis, viral induced liver fibrosis, autoimmune hepatitis, corneal scarring, hypertrophic scarring, Dupuytren disease, keloids, cutaneous fibrosis, cutaneous scleroderma, systemic sclerosis, spinal cord injury/fibrosis, myelofibrosis, vascular restenosis, atherosclerosis, arteriosclerosis, Wegener's granulomatosis, Peyronie's disease, and/or diseases associated with fibroblast migration and differentiation. In particular embodiment said fibrotic condition is a fibrotic condition associated with fibroblast migration and differentiation.

As a further aspect of the invention there is provided the compound of the invention for use as a pharmaceutical especially in the treatment and/or prophylaxis of the aforementioned conditions and diseases. Also provided herein is the use of the present compounds in the manufacture of a medicament for the treatment and/or prophylaxis of one of the aforementioned conditions and diseases.

A particular regimen of the present method comprises the administration to a subject suffering from a fibrotic disease involving fibroblast migration and differentiation, of an effective amount of an expression inhibitory agent for a period of time sufficient to reduce the level of abnormal fibrosis in the subject, and preferably terminate the processes responsible for said fibrotic condition. A special embodiment of the method comprises administering of an effective amount of an antibody or a fragment thereof which specifically binds to a TARGET polypeptide to a subject patient suffering from or susceptible to the development of a fibrotic disease, for a period of time sufficient to reduce or prevent, respectively, fibrotic condition in said patient, and preferably terminate, the processes responsible for said fibrotic condition In particular embodiment said fibrotic condition is a fibrotic condition associated with fibroblast migration and differentiation.

Another aspect of the present invention relates to compositions, comprising a DNA expression vector capable of expressing a polynucleotide capable of inhibition of expression of a TARGET polypeptide and described as an expression inhibitory agent.

The present invention provides compounds, compositions, and methods useful for modulating the expression of the TARGET genes, specifically those TARGET genes associated with a fibrotic disease and for treating such conditions by RNA interference (RNAi) using small nucleic acid molecules. In particular, the instant invention features small nucleic acid molecules, i.e., short interfering nucleic acid (siNA) molecules including, but not limited to, short interfering RNA (siRNA), double-stranded RNA (dsRNA), micro-RNA (miRNA), short hairpin RNA (shRNA) and circular RNA molecules and methods used to modulate the expression of the TARGET genes and/or other genes involved in pathways of the TARGET gene expression and/or activity.

A particular aspect of these compositions and methods relates to the down-regulation or blocking of the expression of the TARGET by the induced expression of a polynucleotide encoding an intracellular binding protein that is capable of selectively interacting with the TARGET. An intracellular binding protein includes any protein capable of selectively interacting, or binding, with the polypeptide in the cell in which it is expressed and neutralizing the function of the polypeptide. Preferably, the intracellular binding protein is a neutralizing antibody or a fragment of a neutralizing antibody having binding affinity to an epitope of a TARGET selected from the group consisting of SEQ ID NO: 57-112. More preferably, the intracellular binding protein is a single chain antibody.

Antibodies according to the invention may be delivered as a bolus only, infused over time or both administered as a bolus and infused over time. Those skilled in the art may employ different formulations for polynucleotides than for proteins. Similarly, delivery of polynucleotides or polypeptides will be specific to particular cells, conditions, locations, etc.

A particular embodiment of this composition comprises the expression-inhibiting agent selected from the group consisting of antisense RNA, antisense oligodeoxynucleotide (ODN), a ribozyme that cleaves the polyribonucleotide coding for a TARGET selected from the group consisting of SEQ ID NO: 1-56, a small interfering RNA (siRNA), and a microRNA that is sufficiently homologous to a portion of the polyribonucleotide coding for a TARGET selected from the group consisting of SEQ ID NO: 1-56, such that the siRNA or microRNA interferes with the translation of the TARGET polyribonucleotide to the TARGET polypeptide.

The polynucleotide expressing the expression-inhibiting agent, or a polynucleotide expressing the TARGET polypeptide in cells, is particularly included within a vector. The polynucleic acid is operably linked to signals enabling expression of the nucleic acid sequence and is introduced into a cell utilizing, preferably, recombinant vector constructs, which will express the antisense nucleic acid once the vector is introduced into the cell. A variety of viral-based systems are available, including adenoviral, retroviral, adeno-associated viral, lentiviral, herpes simplex viral or a sendaiviral vector systems, and all may be used to introduce and express polynucleotide sequence for the expression-inhibiting agents or the polynucleotide expressing the TARGET polypeptide in the target cells.

Particularly, the viral vectors used in the methods of the present invention are replication defective. Such replication defective vectors will usually pack at least one region that is necessary for the replication of the virus in the infected cell. These regions can either be eliminated (in whole or in part), or be rendered non-functional by any technique known to a person skilled in the art. These techniques include the total removal, substitution, partial deletion or addition of one or more bases to an essential (for replication) region. Such techniques may be performed in vitro (on the isolated DNA) or in situ, using the techniques of genetic manipulation or by treatment with mutagenic agents. Preferably, the replication defective virus retains the sequences of its genome, which are necessary for encapsidating, the viral particles.

In a preferred embodiment, the viral element is derived from an adenovirus. Preferably, the vehicle includes an adenoviral vector packaged into an adenoviral capsid, or a functional part, derivative, and/or analogue thereof. Adenovirus biology is also comparatively well known on the molecular level. Many tools for adenoviral vectors have been and continue to be developed, thus making an adenoviral capsid a preferred vehicle for incorporating in a library of the invention. An adenovirus is capable of infecting a wide variety of cells. However, different adenoviral serotypes have different preferences for cells. To combine and widen the target cell population that an adenoviral capsid of the invention can enter in a preferred embodiment, the vehicle includes adenoviral fiber proteins from at least two adenoviruses. Preferred adenoviral fiber protein sequences are serotype 17, 45 and 51. Techniques or construction and expression of these chimeric vectors are disclosed in US 2003/0180258 and US 2004/0071660, hereby incorporated by reference.

In a preferred embodiment, the nucleic acid derived from an adenovirus includes the nucleic acid encoding an adenoviral late protein or a functional part, derivative, and/or analogue thereof. An adenoviral late protein, for instance an adenoviral fiber protein, may be favorably used to target the vehicle to a certain cell or to induce enhanced delivery of the vehicle to the cell. Preferably, the nucleic acid derived from an adenovirus encodes for essentially all adenoviral late proteins, enabling the formation of entire adenoviral capsids or functional parts, analogues, and/or derivatives thereof. Preferably, the nucleic acid derived from an adenovirus includes the nucleic acid encoding adenovirus E2A or a functional part, derivative, and/or analogue thereof. Preferably, the nucleic acid derived from an adenovirus includes the nucleic acid encoding at least one E4-region protein or a functional part, derivative, and/or analogue thereof, which facilitates, at least in part, replication of an adenoviral derived nucleic acid in a cell. The adenoviral vectors used in the examples of this application are exemplary of the vectors useful in the present method of treatment invention.

Certain embodiments of the present invention use retroviral vector systems. Retroviruses are integrating viruses that infect dividing cells, and their construction is known in the art. Retroviral vectors can be constructed from different types of retrovirus, such as, MoMuLV ("murine Moloney leukemia virus") MSV ("murine Moloney sarcoma virus"), HaSV ("Harvey sarcoma virus"); SNV ("spleen necrosis virus"); RSV ("Rous sarcoma virus") and Friend virus. Lentiviral vector systems may also be used in the practice of the present invention.

In other embodiments of the present invention, adeno-associated viruses ("AAV") are utilized. The AAV viruses are DNA viruses of relatively small size that integrate, in a stable and site-specific manner, into the genome of the infected cells. They are able to infect a wide spectrum of cells without inducing any effects on cellular growth, morphology or differentiation, and they do not appear to be involved in human pathologies.

As discussed hereinabove, recombinant viruses may be used to introduce DNA encoding polynucleotide agents useful in the present invention. Recombinant viruses according to the invention are generally formulated and administered in the form of doses of between about 104 and about 1014 pfu. In the case of AAVs and adenoviruses, doses of from about 106 to about 1011 pfu are particularly used. The term pfu ("plaque-forming unit") corresponds to the infective power of a suspension of virions and is determined by infecting an appropriate cell culture and measuring the number of plaques formed. The techniques for determining the pfu titre of a viral solution are well documented in the prior art.

In the vector construction, the polynucleotide agents of the present invention may be linked to one or more regulatory regions. Selection of the appropriate regulatory region or regions is a routine matter, within the level of ordinary skill in the art. Regulatory regions include promoters, and may include enhancers, suppressors, etc.

Promoters that may be used in the expression vectors of the present invention include both constitutive promoters and regulated (inducible) promoters. The promoters may be prokaryotic or eukaryotic depending on the host. Among the prokaryotic (including bacteriophage) promoters useful for practice of this invention are lac, lacZ, T3, T7, lambda $P_r$, $P_l$, and trp promoters. Among the eukaryotic (including viral) promoters useful for practice of this invention are ubiquitous promoters (e.g. HPRT, vimentin, actin, tubulin), therapeutic gene promoters (e.g. MDR type, CFTR, factor VIII), tissue-specific promoters, including animal transcriptional control regions, which exhibit tissue specificity and have been utilized in transgenic animals, e.g. chymase gene control region which is active in mast cells (Liao et al., (1997), Journal of Biological Chemistry, 272: 2969-2976), immunoglobulin gene control region which is active in lymphoid cells (Grosschedl, et al. (1984) Cell 38:647-58; Adames, et al. (1985) Nature 318:533-8; Alexander, et al. (1987) Mol. Cell. Biol. 7:1436-44), mouse mammary tumor virus control region which is active in testicular, breast, lymphoid and mast cells (Leder, et al. (1986) Cell 45:485-95), beta-globin gene control region which is active in myeloid cells (Mogram, et al. (1985) Nature 315:338-40; Kollias, et al. (1986) Cell 46:89-94), the CMV promoter and the Visna LTR (Sidiropoulos et al., (2001), Gene Therapy, 8:223-231)

Other promoters which may be used in the practice of the invention include promoters which are preferentially activated in dividing cells, promoters which respond to a stimulus (e.g. steroid hormone receptor, retinoic acid receptor), tetracycline-regulated transcriptional modulators, cytomegalovirus immediate-early, retroviral LTR, metallothionein, SV-40, E1a, and MLP promoters. Further promoters which may be of use in the practice of the invention include promoters which are active and/or expressed in macrophages or other cell types contributing to inflammation such as dendritic cells, monocytes, neutrophils, mast cells, endothelial cells, epithelial cells, muscle cells, etc.

Additional vector systems include the non-viral systems that facilitate introduction of polynucleotide agents into a patient. For example, a DNA vector encoding a desired sequence can be introduced in vivo by lipofection. Synthetic cationic lipids designed to limit the difficulties encountered with liposome-mediated transfection can be used to prepare liposomes for in vivo transfection of a gene encoding a marker (Felgner, et. al. (1987) Proc. Natl. Acad Sci. USA 84:7413-7); see Mackey, et al. (1988) Proc. Natl. Acad. Sci. USA 85:8027-31; Ulmer, et al. (1993) Science 259:1745-8). The use of cationic lipids may promote encapsulation of negatively charged nucleic acids, and also promote fusion with negatively charged cell membranes (Feigner and Ringold, (1989) Nature 337:387-8). Particularly useful lipid compounds and compositions for transfer of nucleic acids are described in International Patent Publications WO 95/18863 and WO 96/17823, and in U.S. Pat. No. 5,459,127. The use of lipofection to introduce exogenous genes into the specific organs in vivo has certain practical advantages and directing transfection to particular cell types would be particularly advantageous in a tissue with cellular heterogeneity, for example, pancreas, liver, kidney, and the brain. Lipids may be chemically coupled to other molecules for the purpose of targeting. Targeted peptides, e.g., hormones or neurotransmitters, and proteins for example, antibodies, or non-peptide molecules could be coupled to liposomes chemically. Other molecules are also useful for facilitating transfection of a nucleic acid in vivo, for example, a cationic oligopeptide (e.g., International Patent Publication WO 95/21931), peptides derived from DNA binding proteins (e.g., International Patent Publication WO 96/25508), or a cationic polymer (e.g., International Patent Publication WO 95/21931).

It is also possible to introduce a DNA vector in vivo as a naked DNA plasmid (see U.S. Pat. Nos. 5,693,622, 5,589,466 and 5,580,859). Naked DNA vectors for therapeutic purposes can be introduced into the desired host cells by methods known in the art, e.g., transfection, electroporation, microinjection, transduction, cell fusion, DEAE dextran, calcium phosphate precipitation, use of a gene gun, or use of a DNA vector transporter (see, e.g., Wilson, et al. (1992) J. Biol. Chem. 267:963-7; Wu and Wu, (1988) J. Biol. Chem. 263:14621-4; Hartmut, et al. Canadian Patent Application No. 2,012,311, filed Mar. 15, 1990; Williams, et al (1991). Proc. Natl. Acad. Sci. USA 88:2726-30). Receptor-mediated DNA delivery approaches can also be used (Curiel, et al. (1992) Hum. Gene Ther. 3:147-54; Wu and Wu, (1987) J. Biol. Chem. 262:4429-32).

A biologically compatible composition is a composition, that may be solid, liquid, gel, or other form, in which the compound, polynucleotide, vector, and antibody of the invention is maintained in an active form, e.g., in a form able to effect a biological activity. For example, a compound of the invention would have inverse agonist or antagonist activity on the TARGET; a nucleic acid would be able to replicate, translate a message, or hybridize to a complementary mRNA of the TARGET; a vector would be able to transfect a target cell and express the antisense, antibody, ribozyme or siRNA as described hereinabove; an antibody would bind a the TARGET polypeptide domain.

A particular biologically compatible composition is an aqueous solution that is buffered using, e.g., Tris, phosphate, or HEPES buffer, containing salt ions. Usually the concentration of salt ions will be similar to physiological levels. Biologically compatible solutions may include stabilizing agents and preservatives. In a more preferred embodiment, the biocompatible composition is a pharmaceutically acceptable composition. Such compositions can be formulated for administration by topical, oral, parenteral, intranasal, subcutaneous, and intraocular, routes. Parenteral administration is meant to include intravenous injection, intramuscular injection, intraarterial injection or infusion techniques. The composition may be administered parenterally in dosage unit formulations containing standard, well-known non-toxic physiologically acceptable carriers, adjuvants and vehicles as desired.

Pharmaceutical compositions for oral administration can be formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions, and the like, for ingestion by the patient. Pharmaceutical compositions for oral use can be prepared by combining active compounds with solid excipient, optionally grinding a resulting mixture, and processing the mixture of granules, after adding suitable auxiliaries, if desired, to obtain tablets or dragee cores. Suitable excipients are carbohydrate or protein fillers, such as sugars, including lactose, sucrose, mannitol, or sorbitol; starch from corn, wheat, rice, potato, or other plants; cellulose, such as methyl cellulose, hydroxypropylmethyl-cellulose, or sodium carboxymethyl-cellulose; gums including arabic and tragacanth; and proteins such as gelatin and collagen. If desired, disintegrating or solubilizing agents may be added, such as the cross-linked polyvinyl pyrrolidone, agar, alginic acid, or a salt thereof, such as sodium alginate. Dragee cores may be used in conjunction with suitable coatings, such as concentrated sugar solutions, which may also contain gum arabic, talc, polyvinyl-pyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound, i.e., dosage.

Pharmaceutical preparations that can be used orally include push-fit capsules made of gelatin, as well as soft, sealed capsules made of gelatin and a coating, such as glycerol or sorbitol. Push-fit capsules can contain active ingredients mixed with filler or binders, such as lactose or starches, lubricants, such as talc or magnesium stearate, and, optionally, stabilizers. In soft capsules, the active compounds may be dissolved or suspended in suitable liquids, such as fatty oils, liquid, or liquid polyethylene glycol with or without stabilizers.

Particular sterile injectable preparations can be a solution or suspension in a non-toxic parenterally acceptable solvent or diluent. Examples of pharmaceutically acceptable carriers are saline, buffered saline, isotonic saline (for example, monosodium or disodium phosphate, sodium, potassium; calcium or magnesium chloride, or mixtures of such salts), Ringer's solution, dextrose, water, sterile water, glycerol, ethanol, and combinations thereof 1,3-butanediol and sterile fixed oils are conveniently employed as solvents or suspending media. Any bland fixed oil can be employed including synthetic mono- or di-glycerides. Fatty acids such as oleic acid also find use in the preparation of injectables.

The compounds or compositions of the invention may be combined for administration with or embedded in polymeric carrier(s), biodegradable or biomimetic matrices or in a scaffold. The carrier, matrix or scaffold may be of any material that will allow composition to be incorporated and expressed and will be compatible with the addition of cells or in the presence of cells. Particularly, the carrier matrix or scaffold is predominantly non-immunogenic and is biodegradable. Examples of biodegradable materials include, but are not limited to, polyglycolic acid (PGA), polylactic acid (PLA), hyaluronic acid, catgut suture material, gelatin, cellulose, nitrocellulose, collagen, albumin, fibrin, alginate, cotton, or other naturally-occurring biodegradable materials. It may be preferable to sterilize the matrix or scaffold material prior to administration or implantation, e.g., by treatment with ethylene oxide or by gamma irradiation or irradiation with an electron beam. In addition, a number of other materials may be used to form the scaffold or framework structure, including but not limited to: nylon (polyamides), dacron (polyesters), polystyrene, polypropylene, polyacrylates, polyvinyl compounds (e.g., polyvinylchloride), polycarbonate (PVC), polytetrafluorethylene (PTFE, teflon), thermanox (TPX), polymers of hydroxy acids such as polylactic acid (PLA), polyglycolic acid (PGA), and polylactic acid-glycolic acid (PLGA), polyorthoesters, polyanhydrides, polyphosphazenes, and a variety of polyhydroxyalkanoates, and combinations thereof. Matrices suitable include a polymeric mesh or sponge and a polymeric hydrogel. In the particular embodiment, the matrix is biodegradable over a time period of less than a year, more particularly less than six months, most particularly over two to ten weeks. The polymer composition, as well as method of manufacture, can be used to determine the rate of degradation. For example, mixing increasing amounts of polylactic acid with polyglycolic acid decreases the degradation time. Meshes of polyglycolic acid that can be used can be obtained commercially, for instance, from surgical supply companies (e.g., Ethicon, N.J.). In general, these polymers are at least partially soluble in aqueous solutions, such as water, buffered salt solutions, or aqueous alcohol solutions, that have charged side groups, or a monovalent ionic salt thereof.

The composition medium can also be a hydrogel, which is prepared from any biocompatible or non-cytotoxic homo- or hetero-polymer, such as a hydrophilic polyacrylic acid polymer that can act as a drug absorbing sponge. Certain of them, such as, in particular, those obtained from ethylene and/or propylene oxide are commercially available. A hydrogel can be deposited directly onto the surface of the tissue to be treated, for example during surgical intervention.

Embodiments of pharmaceutical compositions of the present invention comprise a replication defective recombinant viral vector encoding the agent of the present invention and a transfection enhancer, such as poloxamer. An example of a poloxamer is Poloxamer 407, which is commercially available (BASF, Parsippany, N.J.) and is a non-toxic, biocompatible polyol. A poloxamer impregnated with recombinant viruses may be deposited directly on the surface of the tissue to be treated, for example during a surgical intervention. Poloxamer possesses essentially the same advantages as hydrogel while having a lower viscosity.

The active agents may also be entrapped in microcapsules prepared, for example, by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences (1980) 16th edition, Osol, A. Ed.

Sustained-release preparations may be prepared. Suitable examples of sustained-release preparations include semipermeable matrices of solid hydrophobic polymers containing the antibody, which matrices are in the form of shaped articles, for example, films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and gamma-ethyl-L-glutamate, non-degradable ethylene-vinyl acetate, degradable lactic acid-glycolic acid copolymers such as the LUPRON DEPOT™. (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

As used herein, therapeutically effective dose means that amount of protein, polynucleotide, peptide, or its antibodies, agonists or antagonists, which ameliorate the symptoms or condition. Therapeutic efficacy and toxicity of such compounds can be determined by standard pharmaceutical procedures in cell cultures or experimental animals, for example, $ED_{50}$ (the dose therapeutically effective in 50% of the population) and $LD_{50}$ (the dose lethal to 50% of the population). The dose ratio of toxic to therapeutic effects is the therapeutic index, and it can be expressed as the ratio, $LD_{50}/ED_{50}$. Pharmaceutical compositions that exhibit large therapeutic indices are particular. The data obtained from cell culture assays and animal studies are used in formulating a range of dosage for human use. The dosage of such compounds lies particularly within a range of circulating concentrations that include the $ED_{50}$ with little or no toxicity. The dosage varies within this range depending upon the dosage form employed, sensitivity of the patient, and the route of administration.

For any compound, the therapeutically effective dose can be estimated initially either in cell culture assays or in animal models, usually mice, rabbits, dogs, or pigs. The animal model is also used to achieve a desirable concentration range and route of administration. Such information can then be used to determine useful doses and routes for administration in humans. The exact dosage is chosen by the individual physician in view of the patient to be treated. Dosage and administration are adjusted to provide sufficient levels of the active moiety or to maintain the desired effect. Additional factors which may be taken into account include the severity of the disease state, age, weight and gender of the patient; diet, desired duration of treatment, method of administration, time and frequency of administration, drug combination(s), reaction sensitivities, and tolerance/response to therapy. Long acting pharmaceutical compositions might be administered every 3 to 4 days, every week, or once every two weeks depending on half-life and clearance rate of the particular formulation.

The pharmaceutical compositions according to this invention may be administered to a subject by a variety of methods. They may be added directly to targeted tissues, complexed with cationic lipids, packaged within liposomes, or delivered to targeted cells by other methods known in the art. Localized administration to the desired tissues may be done by direct injection, transdermal absorption, catheter, infusion pump or stent. The DNA, DNA/vehicle complexes, or the recombinant virus particles are locally administered to the site of treatment. Alternative routes of delivery include, but are not limited to, intravenous injection, intramuscular injection, subcutaneous injection, aerosol inhalation, oral (tablet or pill form), topical, systemic, ocular, intraperitoneal and/or intrathecal delivery. Examples of ribozyme delivery and administration are provided in Sullivan et al. WO 94/02595.

Administration of an expression-inhibiting agent or an antibody of the present invention to the subject patient includes both self-administration and administration by another person. The patient may be in need of treatment for an existing disease or medical condition, or may desire prophylactic treatment to prevent or reduce the risk for diseases and medical conditions affected by differentiation of macrophages into alternatively-activated macrophages. The expression-inhibiting agent of the present invention may be delivered to the subject patient orally, transdermally, via inhalation, injection, nasally, rectally or via a sustained release formulation.

In Vitro Methods

The present invention also provides an in vitro method of inhibiting fibroblast migration and differentiation, said method comprising contacting a population of fibroblasts with an inhibitor of the activity or expression of a TARGET polypeptide. In a particular embodiment said inhibitor is an antibody. In an alternative embodiment said antibody is a monoclonal antibody.

The present invention further relates to an in vitro method of inhibiting fibroblast migration and differentiation, said method comprising contacting a population of fibroblasts with an inhibitor selected from the group consisting of an antisense polynucleotide, a ribozyme, a small interfering RNA (siRNA), microRNA (miRNA) and a short-hairpin RNA (shRNA), wherein said inhibitor comprises a nucleic acid sequence complementary to, or engineered from, a naturally-occurring polynucleotide sequence of about 17 to about 30 contiguous nucleotides of a nucleic acid encoding a TARGET polypeptide.

The down regulation of gene expression using antisense nucleic acids can be achieved at the translational or transcriptional level. Antisense nucleic acids of the invention are particularly nucleic acid fragments capable of specifically hybridizing with all or part of a nucleic acid encoding a TARGET polypeptide or the corresponding messenger RNA. In addition, antisense nucleic acids may be designed which decrease expression of the nucleic acid sequence capable of encoding a TARGET polypeptide by inhibiting splicing of its primary transcript. Any length of antisense sequence is suitable for practice of the invention so long as it is capable of down-regulating or blocking expression of a nucleic acid coding for a TARGET. Particularly, the antisense sequence is at least about 15-30, and particularly at least 17 nucleotides in length. The preparation and use of antisense nucleic acids, DNA encoding antisense RNAs and the use of oligo and genetic antisense is known in the art.

Abbreviations

| | |
|---|---|
| αSMA | alpha Smooth Muscle Actin |
| COPD | chronic obstructive pulmonary disease |
| CTB | CellTiter Blue |
| CTGF | connective tissue growth factor |
| DMEM | Dulbecco's Modified Eagle Medium |
| DNA | deoxyribonucleic acid |
| ECM | extra cellular matrix |
| EMT | Epithelial-Mesenchymal Transition |
| FMT | Fibroblast to myofibroblast transition |
| FPKM | Fragments Per Kilobase of transcript per Million fragments mapped |
| h | hour |
| HI-FBS | Heat inactivated fetal bovine serum |
| IL | Interleukin |
| IPF | idiopathic pulmonary fibrosis |
| max | maximal |

-continued

| | |
|---|---|
| MOI | multiplicity of infection |
| MSD | meso scale discovery platform |
| NHLF | normal human lung fibroblasts |
| PCR | polymerase chain reaction |
| PDGF | platelet-derived growth factor |
| pen-strep | penicillin streptomycin |
| RNA | Ribonucleic acid |
| t | time |
| TGF | transforming growth factor |

EXAMPLES

Example 1 describes the fibroblast scratch screening assay and primary screen using custom adenoviral library.

Example 2 describes the re-screen of identified hits in of the example 1 using fibroblast scratch assay.

Example 3 describes the fibroblast-to-myofibroblast transition (FMT) validation assay.

Example 4 describes the "On-target" analysis

Example 5 describes viability assay.

Example 6 describes whole transcriptome sequencing.

Example 1. Fibroblast Scratch Assay 1.1 Background

Migrating fibroblasts are considered to play a major role in the pathology of idiopathic pulmonary fibrosis. The fibroblast scratch assay is a wound healing assay that is a measure for cell motility and migration. The propensity of lung fibroblasts to close an open wound in a cell monolayer is considered to predict their contribution to idiopathic pulmonary fibrosis.

1.2 Lung Fibroblasts

In order to set up the fibroblast scratch assay and FMT assay, human lung fibroblasts derived from three healthy (normal human lung fibroblasts, NHLF) donors, were used.

TABLE 2

Overview of lung fibroblast donors used in the assays

| Donor name | Type | Age | Sex | Supplier | Cell passage | Used for |
|---|---|---|---|---|---|---|
| FB0054 | NHLF | 67 Y | M | Epithelix | 1 | Primary screen and OT |
| FB0202 | NHLF | 67 Y | F | Epithelix | 1 | Validation assay |
| 99218 | NHLF | 19 Y | F | LONZA | 2 | Re-screen |

The cells are routinely cultured and expanded in Dulbecco's Modified Eagle Medium (DMEM) supplemented with 10% heat-inactivated fetal bovine serum (HI-FBS) and penicillin-streptomycin at 37° C., 5% $CO_2$ in a humidified atmosphere.

1.3 Coating of Plates

Migration of fibroblasts is influenced by the extracellular matrix. Therefore, optimal coating conditions for cell seeding must be used. PureCol (98% collagen I and 2% collagen III) was used and, as a control, the scratch area was measured directly (t=0 h) or 20 h (t=20 h) after scratching. Comparing scratch areas of PureCol revealed robust performance with little well-to-well variation. In addition, at t=20 h (Trigger: 2% FBS) the wound completely closed on PureCol coated plates.

1.4 Algorithm for Analyzing Wound Area

The wound area resulting from scratching of fibroblast monolayers was measured by high content imaging on an InCell200 instrument (GE Healthcare) following immune staining with Rhodamin-Phalloidin and DAPI, and subsequently analyzed using an in-house-developed algorithm with InCell developer software. FIG. 1 shows examples of algorithm-based segmentation of an open and closed fibroblast scratch wound. The segmentation indicated in the segmentation figures is based on the maximal open area of the scratch in images of rhodamin-phalloidin stained cells, and the nuclei based on DAPI staining of the nuclei. The maximal open area is defined as the largest open area within a mechanical scratch wound in a fibroblast monolayer. The rhodamin-phalloidin-based segmentation was used to quantify the maximal open area in the fibroblast scratch assay.

This algorithm allowed the measurement of two parameters: i) total open area which is the sum of all segmented areas, and ii) maximal open area (further referred to as max open area), which only includes the largest open area.

The max open area parameter has the advantage that intercellular spaces that are formed upon migration of cells are excluded, but may have the risk of losing part of the total open area due to separation of an open area by migrating cells. Therefore, measurement of the max open area was used as a measure of wound closure.

1.5 Trigger

In order to obtain an optimal window of measurement, various triggers can be used at different time points (pre- or post-scratch). A skilled person would be aware of a number of such possible triggers. These triggers can be IL-13, CCL21, CTGF and PDGF-BB in the presence or absence of fetal bovine serum (FBS). FBS contains multiple growth stimulation factors.

50 ng/mL PDGF-BB in combination with 2% FBS in DMEM was used as a trigger in the fibroblast scratch assay described further below.

1.6 Negative and Positive Controls

Each 96-well plate contained 2 negative control shRNAs, one against a non-expressed gene (luciferase; luc_v13) and one against the murine nitric oxide synthase gene (mmNos_v3). In addition, also a "no virus" control was used as a negative control. Besides, 5 positive (PIK3C3_v3, CXCR4_v14, PDGFRA_v12, COL1A1_v5, and PGK1_v2) controls were also used and the summary of the controls is presented in Table 3.

TABLE 3

Overview of positive and negative controls used in the primary screen.

| Control | Control name | Knock-down target sequence | SEQ ID NO |
|---|---|---|---|
| N1 | PerC6 | N.A. | N.A. |
| N2 | mmNos_v3 | TTCCTGGACATCACTTCCC | 113 |
| N3 | Luc_v13 | GGTTACCTAAGGGTGTGGC | 114 |
| P1 | PIK3C3_v3 | CAGTGTTACACGGCTTTCC | 115 |
| P2 | CXCR4_v14 | TGGATTGGTCATCCTGGTC | 116 |
| P3 | PDGFRA_v12 | TTGTTGAGCTTCACCTATC | 117 |
| P4 | COL1A1_v5 | GAGCATGACCGATGGATTC | 118 |
| P5 | PGK1_v2 | GATTACCTTGCCTGTTGAC | 119 |

Calculation of the percentage wound closure of putative positive controls as compared with negative controls is calculated according the following equation:

$$\% \text{ wound closure} = \frac{t_0 - t_{x(pos\ ctrl)}}{t_0 - t_{x(ave\ neg\ ctrls)}} \times 100\%$$

In this equation the wound closure in the time frame between initial scratching (t0) and fixation (tx) of a putative positive control is divided by the average wound closure of negative controls in the same time frame, set as a percentage. Data were expressed both as max open area as well as percentage wound closure and it was verified that at least one of the positive controls showed >60% inhibition of wound closure as compared to the average of three negative controls in both donors.

1.7 Control of Cell Proliferation

PDGF-BB is a growth factor and may therefore not only induce migration but also subsequent cell proliferation. The time frame cells were allowed to migrate into a scratched wound was limited to 20 h and hence PDGF-BB and/or FBS induced migration may not yet be enhanced. To monitor possible contribution of cell proliferation to the observed induction of wound closure, cell numbers were counted in areas surrounding the scratches. Comparing nuclear counts in these areas under triggered and un-triggered conditions confirmed that no significant increase was observed and thus no enhanced proliferation took place in the first 16 h after scratching. Transduction of the cells prior to scratching results in a slight decrease in cell number. This decrease appears to be a general adenoviral effect regardless of the shRNA construct the virus contains.

1.8 Primary Screen

For the primary screen the normal human lung fibroblast donor FB0054 at passage three was selected. The primary screen was performed using over >12,000 adenoviral shRNA constructs from in-house adenoviral library. The full screen consisted of 140×96-well plates and was performed in biological duplicate. The assay setup for the primary screen was under the following conditions:
Trigger: 0.2% HI-FBS+50 ng/mL PDGF-BB
Cells: NHLF from donor FB0054 (passage three)
Read-out: Max open area.
MOI: 24

Figure 2:
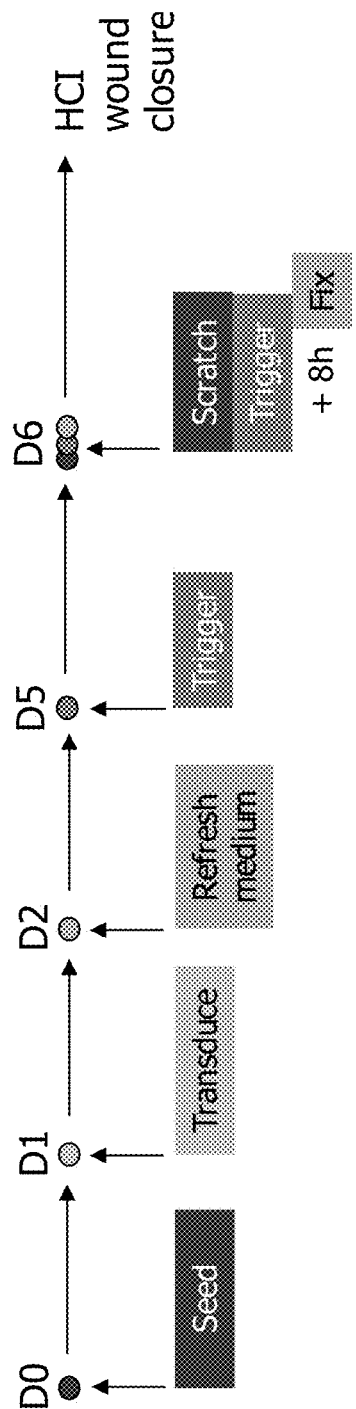
FIG. 2 outlines the assay set-up of the fibroblast scratch assay.

On day 0 NHLF cells from donor FB0054 were seeded at 3000 cells/well on PureCol-coated plates, and subsequently transduced with adenoviral constructs the next day with an MOI of 24 infectious units per cell. The transduced cells were then triggered with 50 ng/mL PDGF-BB+0.2% FBS on day 5 and scratch was performed on day 6. Following scratching, the cells were triggered again with the same trigger and fixed 8 h after scratch. An in-house developed algorithm as described in 1.4 was used to analyze the images, using the max open area. The screening protocol is schematically presented in FIG. 2.

1.9 Data Analysis

To assess possible irresolvable plate position artifacts such as edge effects or patterns associated with liquid handling, heat maps were generated for each plate. Comparing different source plates using the heat maps revealed that no plate effects could be detected.

Primary screen plates were analyzed if biological duplicates showed a Spearman rank correlation of >0.4 or a Kappa statistics value >0.2. The performance of the screen was considered of good quality, if upon hit calling at least 3 out of 5 positive controls showed up as duplicate hit.

In order to determine which statistical method should be used for hit calling, frequency distribution plots of all data points were generated. The frequency distributions of the samples indicated a right-skewed, non-Gaussian distribution.

In order to perform hit calling on this right-skewed data distribution, an appropriate statistical method should be used. An IQR-based normalization method is therefore most applicable, since this method is less sensitive to asymmetric distributions. The IQR method uses the median (Q2) and inter quartile range (Q3-Q1) as a measure for data dispersion. When analyzing a highly skewed data set, it is possible to take an alternative measurement of data spread, for instance median and (Q1-Q2) or median and (Q3-Q2) depending on whether inhibitors or activators are of interest respectively. The choice of cut-off determines the error rate (probability of identifying a non-hit as a hit). Therefore, for hit calling, an IQR method was used with IQR3 as a measure of sample distribution (median and Q3-Q2).

1.10 Results

A clear separation between positive and negative controls was observed, with P3 demonstrating the strongest inhibition, while P2, P4, and P5 showed a moderate inhibition of wound healing. P1 did not demonstrate similar performance in the primary screen.

Based on the separation between the negative and positive control samples, a cut-off was set at 1.5 for hit calling of the complete primary screen. At this cut-off <5% of the negative controls were allowed to be identified as hit (false positive). Furthermore, it was verified at least one out of five positive controls should be identified as hit or 3 of 5 positive controls should induce over 40% inhibition of wound closure. Based on these requisitions, 22 of 140 plates did not meet these criteria (15.7% fail rate) and were repeated successfully in a backup screen.

A clear separation of positive and negative controls was observed. In addition, the Spearman rank correlations were >0.4 and the kappa values were larger than 0.2 for all plates.

Based on an IQR cut-off value of 1.5 a total of 1074 unique viral constructs were identified as duplicate hits, inhibiting wound healing.

Example 2. Rescreen of shRNA Hits Identified in Fibroblast Scratch Assay 2.1 Re-Screening Protocol The 1074 unique viruses, which were identified as a hit in the primary screen, were re-propagated for the rescreen phase. The rescreen was performed using similar test conditions as in the primary screen (Example 1), but in a different donor in order to eliminate donor specific effects of viruses. Here the NHLF donor 99218 (passage four) was used, and seeded at a concentration of 3000 cells/well. For the transduction a different layout was used, since hit calling in the rescreen would be based on negative controls. Therefore at least 30% of the 96 wells in each plate consisted of negative controls. In addition, five positive controls were included in column seven. The identity of the control set is listed in Table 4.

TABLE 4

Control set used in re-screen

| Control | Control name | Knock-down target sequence | SEQ ID NO |
|---|---|---|---|
| N1 | EMPTY02 | N.A. | N.A. |
| N2 | ffluc_v22 | GCACATATCGAGGTGAACA | 120 |
| N3 | PerC6 | N.A. | N.A. |
| P1 | PIK3C3_v3 | CAGTGTTACACGGCTTTCC | 115 |
| P2 | CXCR4_v14 | TGGATTGGTCATCCTGGTC | 116 |
| P3 | PDGFRA_v12 | TTGTTGAGCTTCACCTATC | 117 |
| P4 | COL1A1_v5 | GAGCATGACCGATGGATTC | 118 |
| P5 | MAPK14_v20 | TGATGTGTATCTGGTGACC | 121 |

Cells were triggered with 0.2% HI-FBS plus 50 ng/mL PDGF-BB and the maximum open area of the wound was measured. MOI 12 was used and the time of wound closure was set at 13 h. Subsequently the complete rescreen was performed in one batch using these optimal conditions.

2.2 Data Analysis

In the rescreen, the performance of positive and negative controls served as success criteria for each plate. The data distribution of duplicate raw values showed a Spearman rank correlation of 0.73 between duplicates. In addition, a clear separation was observed between signals of positive and negative controls.

Hit identification on rescreen data was performed using the Robust Z-score based on negatives. The "Robust Z-score method" combines negative control measurements altogether under the assumption that they are inactive and serve as controls, taken into account outlier values in order to minimize their undesirable influence (Malo et al. 2006). A separation between positive and negative controls was observed, with P3 being the strongest inhibitor, and P2, P4, and P5 being moderate inhibitors of wound healing.

2.3 Results

Figure 3:
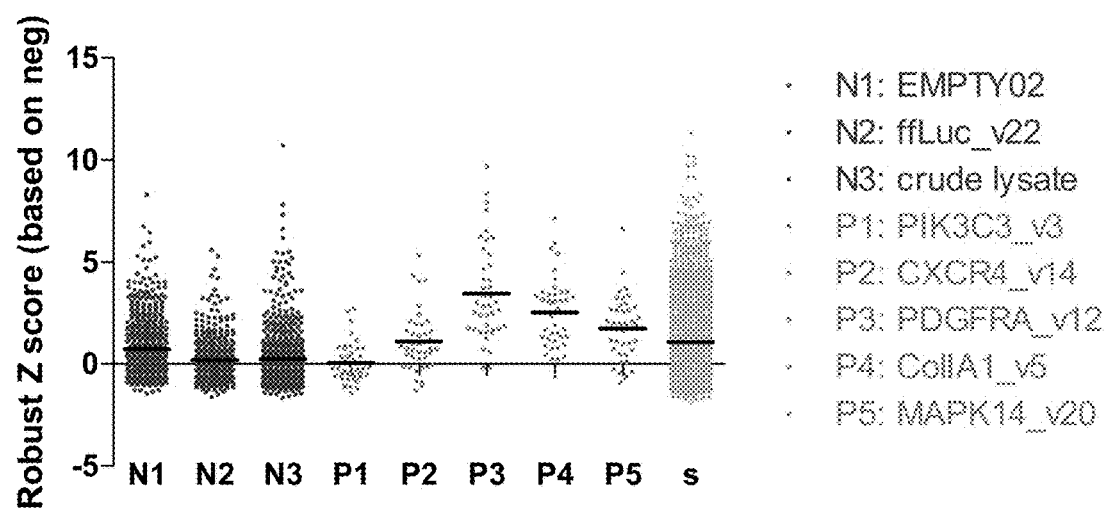
FIG. 3 shows dot plots of rescreen data. Controls and samples data are presented after normalizing the data using robust Z-score.

An overview of the results obtained for the controls and samples in given on FIG. 3. The robust Z-score method with a cut-off of 1.2 was used for the rescreen. At this cut-off less than 5% of negative controls were identified as false positive hits, while over 71% of positive controls were a hit (Table 5). After sequence confirmation, 216 shRNA constructs were identified targeting 229 genes.

TABLE 5

Overview of confirmed hits and control performance in the Rescreen

| Cut-off | # hits (% hits) | % pos ctrl as hit* | % pos ctrl as hit** | % neg ctrl as hit |
|---|---|---|---|---|
| 1.2 | 216 (20%) | 71% | 91% | 5% |

*percentage is based on number of P3 and P4 controls identified as duplicate hit
**percentage is based on number of P3 controls identified as duplicate hit Example 3. Fibroblast-to-Myofibroblast Transition (FMT) Assay 3.1 Background Myofibroblasts are considered to play a major role in the pathology of idiopathic pulmonary fibrosis. The fibroblast-to-myofibroblast transition (FMT) assay, using α-smooth muscle actin (αSMA) as read-out, enables high throughput identification of genes involved in the myofibroblast differentiation of lung-derived fibroblasts.

3.2 Trigger

Trigger was added in DMEM supplemented with 0.2% HI-FBS. The cells were triggered with 0.5 ng/mL TGFβ for 72 hrs. The most optimal window between triggered and non-triggered cells was observed using this concentration of the trigger.

3.3 Image Analysis Algorithm

Figure 4:
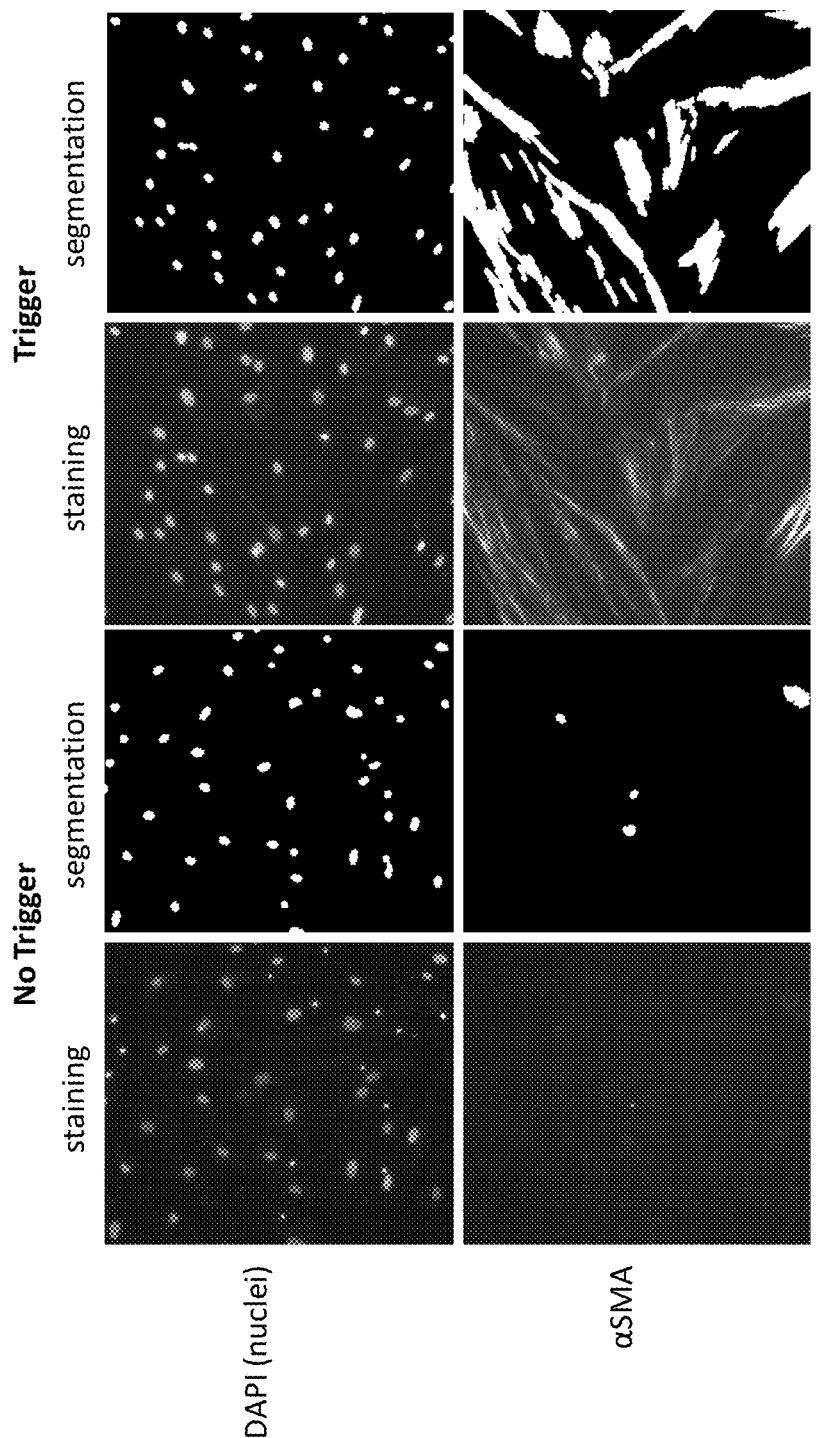
FIG. 4 shows image segmentation principles based on DAPI staining of nuclei and αSMA staining of cells either non-triggered or triggered with TGFβ.

The expression of αSMA in fibroblasts undergoing FMT in response to TGFβ was measured by high content imaging on an InCell200 instrument (GE Healthcare) following immune staining with mouse-anti-human αSMA, followed by donkey-anti-mouseAlexa546, and DAPI, and subsequently analyzed using an in-house developed algorithm with InCell developer software (GE Healthcare). The segmentation indicated in the segmentation images of FIG. 4, is based on the staining of αSMA, and the nuclei based on DAPI staining. The αSMA-based segmentation was used to identify the myofibroblasts in the image. The density times the stained area was used to quantify the αSMA expression in the image, which is a measure for FMT. A clear increase in αSMA positive cells was observed for fibroblasts triggered with TGFβ as compared to the no trigger condition, whereas no difference was observed in the number of nuclei between non-triggered and triggered conditions.

Error! Reference source not found. FIG. 4 shows the principles of the algorithm-based segmentation. The red lines indicate the segmentation based on DAPI staining of the nuclei, while the green lines indicate segmentation based on images of αSMA staining. These images clearly showed that the green lines closely align with the αSMA positive cells and hence this αSMA-based segmentation was use in data analysis.

3.4 Putative Negative and Positive Controls

Three negative controls shRNAs against non-expressed genes (Aequorea victoria green fluorescent protein; aveGFP and firefly luciferase; ffLuc_v21 and ffLuc_v24) were selected. The putative positive controls were selected based on their role in the TGFβ pathway. In a panel of five putative positive controls at least three (P1, P2, and P5) were shown to be able to inhibit the αSMA expression down to basal levels. The overview of the negative and positive controls is presented in Table 6.

TABLE 6

Contents of control set.

| Control | Control name | Knock-down target sequence | SEQ ID NO |
|---|---|---|---|
| N1 | aveGFP_v17 | GCCACAACGTCTATATCAT | 122 |
| N2 | ffLuc_v21 | ATATCGAGGTGAACATCAC | 123 |
| N3 | ffLuc_v24 | GCATAAGGCTATGAAGAGA | 124 |
| P1 | PIK3C3_v3 | CAGTGTTACACGGCTTTCC | 115 |
| P2 | AKT1_v5 | TGATGGCACCTTCATTGGC | 125 |
| P3 | AKT1_v7 | GATCATGCAGCATCGCTTC | 126 |
| P4 | MAPK8_v1 | AACCTATAGGCTCAGGAGC | 127 |
| P5 | SMAD4_v7 | GCAGAGTAATGCTCCATCA | 128 |

3.5 FMT Assay Protocol

Figure 5:
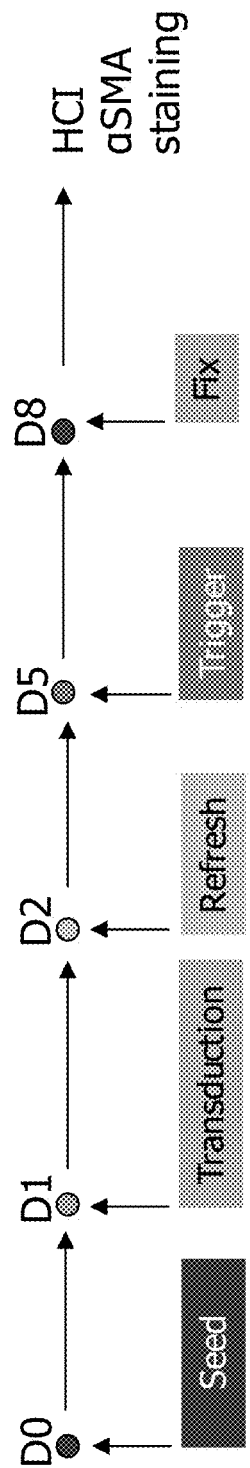
FIG. 5 outlines the assay setup of the fibroblast-to-myofibroblast transition (FMT) assay.

The set-up of the FMT screening protocol is presented in FIG. 5. The complete validation assay was performed in the normal human lung fibroblast donor FB0202 (passage three). The cells were seeded at a concentration of 3000 cells/well on PureCol-coated 96-well plates. On day one, cells were transduced with the 216 shRNA carrying viruses from the fibroblast wound assay rescreen (Example 2). On three plates a well with non-transduced cells was taken along in order to monitor the general virus effect on the αSMA expression. On day five, cells were triggered with 0.5 ng/mL TGFβ and the cells were allowed to undergo FMT for three days. On day eight the αSMA expression was determined using high content imaging and subsequently quantified using the above-described algorithm (see 3.3).

For the validation of the 216 confirmed hits a different plate layout was used, in which the outer wells were excluded in order to avoid possible plate effects. Furthermore, to enable hit identification based on negative controls, at least 30% of the wells in each plate consisted of negative controls. In addition, five positive controls were included.

3.6 Results

Figure 6:
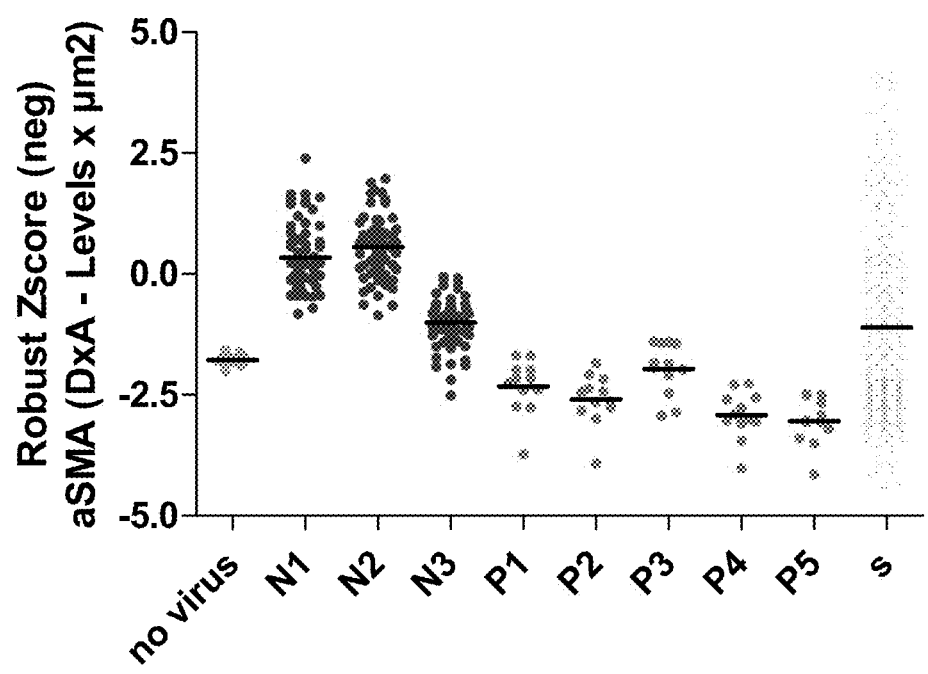
FIG. 6 shows dot plots of controls and samples based Robust Z-Score normalization in FMT assay.

A clear separation between positive and negative controls was observed (FIG. 6). The correlation between biological duplicates was compared using Spearman rank correlation. For all duplicate plates the Spearman coefficient was 0.92 or higher.

Similar to the rescreen of Example 2, the Robust Z-score based on negatives was used for hit calling in the FMT validation screen. FIG. 6 shows the results for controls and samples after normalization with the Robust Z-score. Transduction of cells with adenoviral constructs, resulted in an increase in αSMA expression in fibroblasts. However, this appeared to be a general virus effect irrespective of the encoded shRNA. Four out of five selected positive adenoviral controls did inhibit FMT below the basal levels expressed by fibroblasts triggered with TGFβ only.

To determine the robust Z-score cut-off value to be used for hit identification, at least 4 out of 5 positive controls should be identified as a hit, with none of the negative controls as false positive and only one of the six "no virus" samples as false negative. All plates fulfilled these additional acceptance criteria at a cut-off of ≤−1.8 and therefore this cut-off was selected for hit calling. In addition, single hits with a Z-score ≤−1.8 cut-off of which the corresponding replicate had a Z-score ≤−1, were also considered.

Using the indicated cut-off values, 112 viruses targeting 116 candidate genes were identified.

Example 4. "On-Target" Analysis 4.1 Background and the Set-Up of the Validation Screen Protocol The on target analysis was performed using similar test conditions as in the primary screen (Example 1), in the same normal human fibroblast donor FB0054 (passage three). For each of the 116 candidate Targets from Example 3, at least five additional constructs were designed, produced, and re-propagated.

4.2 Positive and Negative Controls and Plate Layout

As hit calling in the "on target" assay would be based on negative controls, at least 30% of the wells in each plate consisted of negative controls (N1: non transduced cells, N2: ffluc_v22, N3: mmNos3_v3) while five positive controls, which are expected to have an inhibitory effect on fibroblast migration based on public resources were also included in each plate (P1: PIK3C3_v3, P2: CXCR4_v4, P3: PDGFRA_v12, P4: MAPK14_v20, P5: SMAD4_v7). The outer wells on the plates were left empty to avoid potential edge effects.

4.3 On Target Screen Protocol

NHLF cells from donor FB0054 were seeded at a density of 3000 cells per well and subsequently transduced. Cells were then triggered with 0.2% HI-FBS plus 50 ng/mL PDGF-BB and the maximum open area was measured. MOI of 18 was used for the viral transduction, and the optimal timing for the measurement of wound closure was set at 12 h.

4.4 Data Analysis and Results

Figure 7:
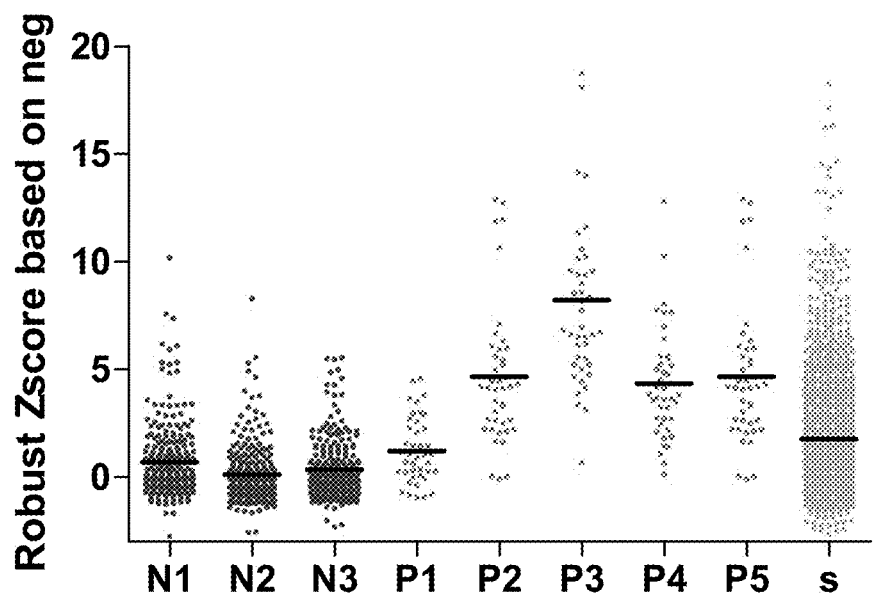
FIG. 7 shows dot plots of controls and samples after Robust Z-Score normalization based on negative controls in the "on target" assay.

The Robust Z-score based on negatives was used for hit calling in the "on target" screen. FIG. 7 shows the results for controls and samples after normalization with the Robust Z-score. To determine the robust Z-score cut-off for hit calling, at least 3 out of 4 positive controls should be identified as a hit and less than 3% of the negative controls are allowed to give a false positive result. All plates fulfilled these additional quality control criteria at a cut-off of ≥1.5. Based on this cut-off 33 confirmed candidate Targets were identified, of which the original hit and at least one additional construct were identified as hits. In addition, for 12 candidate Targets, two or more shRNAs were identified as hit, but not the original construct. Therefore, in total 45 Targets were identified in "on target" analysis.

Example 5. Viability Assays 5.1 Background

To exclude hits that can be identified as false positives due to cytotoxicity, both a CellTiter Blue (CTB) assay and a nuclear count measurement can be performed.

The CTB assay is based on the ability of living cells to convert resazurin (a redox dye) into resorufin (a fluorescent end product). Nonviable cells rapidly lose metabolic capacity and thus do not generate a fluorescent signal. As a reference for cytotoxicity, a serial dilution of staurosporin was taken along on each plate. Loss of cells is indicative for toxicity and therefore nuclear count was used to assess cytotoxicity.

5.2 Protocol for CTB Assay

Figure 8:
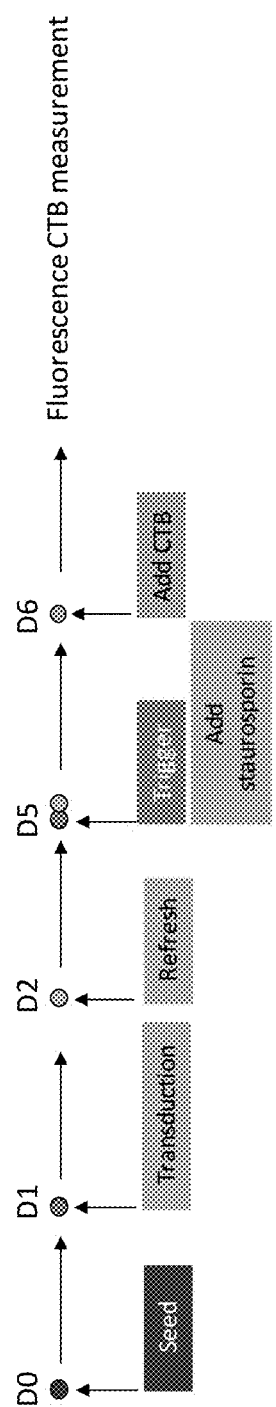
FIG. 8 shows a schematic overview of the CellTiter Blue (CTB) toxicity assay.

The assay setup was the same as for the "on target" screen (see Example 4) and a schematic overview is depicted in FIG. 8. The fluorescence measurement of CTB was performed 24 hrs after addition of a solution containing resazurin. To identify viruses inducing toxicity, CTB fluorescence levels of individual viruses were compared with the average of the negative controls. Viruses demonstrating CTB values that are lower than 70% of the negative control average were considered toxic and were therefore excluded.

5.3 Protocol for Nuclear Counts Assay

In a similar assay setup as described in 5.2, cell numbers were counted, using nuclear counts, upon transduction with the same viruses. For the nuclear count, the negative controls were also averaged and a cut-off was set at 70%.

5.4 Results

As with the CTB, none of the viruses was identified as cytotoxic in the nuclear count assay, and hence no candidate target genes from the example 4 were excluded based on toxicity result.

Example 6. Whole Transcriptome Sequencing 6.1 Background

To confirm mRNA expression of the TARGETs in fibroblasts, mRNA was isolated from these cells to perform whole transcriptome sequencing. Whole transcriptome sequencing, or mRNA-seq, is a cDNA sequencing application that can be used to profile the entire mRNA population and that enables mapping and quantification of all transcripts. With no probes or primer design needed, mRNA-seq has the potential to provide relatively unbiased sequence information from polyA-tailed RNA for analysis of gene expression, novel transcripts, novel isoforms, alternative splice sites, and rare transcripts in a single experiment, depending on read depth.

6.2 Sample Preparation

Normal human lung fibroblasts of donor FB0202 (Epithelix) passage 2 were cultured in DMEM supplemented with 10% HI-FCS, 100 IU/ml penicillin and 100 µg/mL streptomycin. Cells were cultured at 37° C., 5% $CO_2$, in a humidified atmosphere. After five days of maintenance culture, the cells were seeded on Purecol coated 96-well flat bottom plates at a density of 3000 cells/well in DMEM supplemented with 2% HI-FCS, 100 IU/mL penicillin and 100 µg/mL streptomycin. For the untriggered sample (FIB-202-U), cells of two 96-well plates were harvested 24 hrs after seeding for RNA isolation. Two other 96-well plates were triggered (FIB-202-T) with 0.2% Hi-FCS and 0.5 ng/mL TGFβ, five days after seeding. The cells were triggered for 72 hrs, and were subsequently harvested for RNA isolation.

6.3 RNA Isolation and Quality Analysis

Total RNA was isolated from cultured cells using a commercially available RNA isolation kit (RNeasy Mini Kit, Qiagen). Concentration and purity was checked using the NanoDrop 2000 (Thermo Scientific) before sending the mRNA for RNA-sequencing.

The quality and integrity of the RNA sample(s) was analyzed on a RNA 6000 Lab-on-a-Chip using the Bioanalyzer 2100 (Agilent Technologies). Sample quality met the requirements for sample preparation. The Illumina® mRNA-Seq Sample Prep Kit was used to process the samples. The sample preparation was performed according to the Illumina protocol "Preparing Samples for Sequencing of mRNA" (1004898 Rev. D). Briefly, mRNA was isolated from total RNA using the poly-T-oligo-attached magnetic beads. After fragmentation of the mRNA, cDNA synthesis was performed. This was used for ligation with the sequencing adapters and PCR amplification of the resulting product. The quality and yield after sample preparation was measured with a DNA 1000 Lab-on-a-Chip (Agilent Technologies) and all samples passed the quality control. The size of the resulting products was consistent with the expected product with a broad size distribution between 300-600 bp.

6.4 Clustering and DNA Sequencing

Clustering and DNA sequencing using the Illumina HiSeq 2000 (Solexa) were performed according manufacturer's protocols. A total of 6.5 pmol of DNA was used. Two sequencing reads of 100 cycles each using the Read 1 and Read 2 sequencing primers were performed with the flow cell.

6.5 Raw Data Processing

Image analysis, base-calling, and quality check was performed with the Illumina data analysis pipeline RTA v1.13.48 and/or OLB v1.9 and CASAVA v1.8.2. QA analysis performed to evaluate the quality of an Illumina sequencing run was based on quality metrics for a standard run of good quality using the Solexa technology. All lanes of the flow cell passed the QA analysis. Additionally, detailed error rate information based on an Illumina supplied Phi X control was reported. The Phi X control is spiked into the sample in a small amount (up to 5% of the reads). The reads from the Illumina control DNA are removed by the Illumina pipeline during processing of the data. The error rate is calculated after alignment of the reads passing the quality filter to the Phi X reference genome using the ELAND aligner in the Illumina pipeline. All error rates were within the allowed criteria.

6.6 Data Analysis

Reads obtained from the Illumina HiSeq 2000 sequencer were filtered by quality scores with a minimum threshold of Q25 and minimum length of 50 bases. Reads were then aligned to the human reference genome (hg19) with the Bowtie v0.12.7 aligner for each sample. New isoforms were identified with the Cufflinks v2.02 package using default settings and the known transcriptome annotation as mask (Homo_sapiens.GRCh37.65.gff). After new isoform identification for each sample, the newly detected isoforms were merged for all samples and added to the standard transcriptome annotation. Finally, FPKM (Fragments Per Kilobase of transcript per Million fragments mapped) values were calculated with Cufflinks for each sample and reported in the default Cufflinks output. The FPKM values are a quantitative representation of the mRNAs in the samples and therefore in the cells used for the mRNA-seq analysis and the screening assays. Highly abundant mRNAs result in high FPKM values whereas low FPKM values represent low copy numbers of the mRNA.

6.7 Results

The results of this analysis are included in Table 13 and were used as selection criteria for the TARGETs. Expression data were listed as FPKM values. The results demonstrate that 8 out of 33 genes were not expressed by NHLF, whereas the other 25 genes were expressed by NHLF.

Example 7. Testing siRNAs Against the TARGETs in FMT Assay 7.1 Background

To exclude that the shRNA knockdown constructs have an effect on expression of a different mRNA then the intended mRNA, so called off-target effect, an on-target validation was performed with the confirmed candidate Targets using siRNA constructs against selected TARGETS.

7.2 Positive and Negative Controls siRNA against ACTA2, SMAD3, SMAD4, TGFBR1 and TGFBR2 were used as positive controls and non-targeting siRNA (Thermo Fisher Scientific Biosciences GMBH) was used as a negative control.

7.3 siRNA Screening Assay Protocol

The experimental setup was as follows: On day 0 3000 cells/well of normal human lung fibroblast were seeded in 96-well plates with 3.2 µg/mL PureCol coating (Advanced Biomatrix Cat#5005-B). Three days later the siRNA transfection was preformed. Cells were transfected using 0.02 µL/well of Dharmafect 1 (Thermo, Cat # T-2001-03). OnTarget Plus siRNA (Thermo Fisher Scientific Biosciences GMBH) in the final concentration of 20 nM were used as smart pools of 4 constructs per well. For RHBDL2 each siRNA construct was also tested individually. One day after medium was refreshed. On day 5 cells were triggered using 0.5 to 2 ng/mL TGFβ. On day 7 cells were fixed. To fix the cells the medium was first removed subsequently 4% formaldehyde (prepared fromMerck cat #1.04002) was added to the cells, incubated for 30 min and finally replaced with PBS. On the same day RNA isolation was performed using standard MagMax Total RNA isolation kit (Ambion, Cat # AM1830). α-SMA staining and measurement was performed on day 8. The expression of αSMA in fibroblasts undergoing FMT in response to TGFβ was measured by high content imaging on an InCell200 instrument (GE Healthcare) following immuno staining with mouse-anti-human αSMA, followed by donkey-anti-mouse Alexa546, and DAPI, and subsequently analyzed using an in-house developed algorithm with InCell developer software (GE Healthcare). Nuclei count was used as a quality control.

7.4 Data Analysis

Normalized percentage inhibition (NPI) analysis was used to quantify the effect of siRNA constructs on the read-out. ACTA2 siRNA was used as a positive control and non-targeting siRNA as a negative control in the calculations. Normalized percentage inhibition (NPI) was calculated by dividing the difference between sample measurements and the average of positive controls through the difference between positive and negative controls.

Example 8. "On-Target" Fibroblast-to-Myofibroblast Transition (FMT) Assay 8.1 Background and the Set-Up of the Screening Protocol The fibroblast-to-myofibroblast transition (FMT) assay, using α-smooth muscle actin (αSMA) as read-out, was used to perform additional validation of the targets using shRNA constructs.

8.2 Positive and Negative Controls and Plate Layout

Three negative controls shRNAs were used: 2 against the genes non-expressed in the target cells (Aequorea victoria green fluorescent protein; aveGFP and murine nitric oxide synthase gene; mmNos3) and one control being non-transduced cells. Positive controls were selected based on their role in TGFβ pathway, in particular ACTA2 (gene coding for αSMA) was selected as positive control. The overview of the negative and positive controls is presented in Table 7.

TABLE 7

Contents of the control set.

| Control | Control name | Knock-down target sequence | SEQ ID NO |
|---|---|---|---|
| N1 | EMPTY | — | — |
| N2 | mmNos3_v3 | TTCCTGGACATCACTTCCC | 113 |
| N3 | aveGFP_v17 | GCCACAACGTCTATATCAT | 122 |
| P1 | ACTA2_v4 | GAGATCTCACTGACTACCT | 173 |
| P2 | SMAD4_v7 | GCAGAGTAATGCTCCATCA | 128 |
| P3 | TGFBR2_v7 | GCAGTCAAGTTTCCACAAC | 174 |
| P4 | ACTA2_v2 | GTTATGTAGCTCTGGACTT | 175 |

8.3 "On Target" Screen Protocol

NHLF cells from donor FB0054 (passage 3) were seeded at a density of 3000 cells per well in 96-well plates coated with 32. µg/mL PureCol in 2% FBS-DMEM. Cells were transduced one day later. MOI of 18 was used for the viral transduction. One day after transduction the medium was refreshed. On day 6 the cells were triggered using 2 ng/mL TGFβ-1 in 2% FBS-DMEM. On day 7 a dilution range of Staurosporin was added to the control wells (one column per plate). The Staurosporin treatment was performed for around 20 hours, whereby plates were incubated at 37° C. at 5% $CO_2$. On day 8 the supernatant was harvested and the cells were fixed. For fixing, 4% formaldehyde was added to the cells, incubated for 30 min at room temperature and subsequently replaced by PBS (Gibco Cat #10010).

The expression of αSMA in fibroblasts undergoing FMT in response to TGFβ-1 was measured by high content imaging on an InCell200 instrument (GE Healthcare) following immune staining with mouse-anti-human αSMA, followed by donkey-anti-mouseAlexa546, and DAPI, and subsequently analyzed using an in-house developed algorithm with InCell developer software (GE Healthcare). The same protocol was used as described in the Example 3.

8.4 Data Analysis and Results

Normalized percentage inhibition (NPI) analysis was used to quantify the effect of shRNA constructs on the read-out. Average measurements of ACTA2_v4 values were used as a positive control and the values mmNos3_v3 negative control were used in the calculations. Normalized percentage inhibition (NPI) was calculated by dividing the difference between sample measurements and the average of positive controls through the difference between positive and negative controls. A construct demonstrating at least 40% inhibition on that scale was considered "on-target".

shRNA constructs against two specific targets were tested: PTGIR and RHBDL2. At least 2 shRNA constructs against PTGIR and RHBDL2 targets showed significant levels of inhibition with PTGIR having all 5 constructs demonstrating more than 40% inhibition of αSMA production and 4 out of 9 constructs against RHBDL2 demonstrating at least 40% inhibition.

Example 9. TARGET Expression in Animal Models of Fibrosis

9.1 Background

To study the expression of the TARGET genes in vivo, several mouse and rat models of fibrosis were tested and expression in specific tissues like kidney, lung and skin were determined.

9.2 Mouse UUO (Unilateral Ureteral Obstruction) Renal Fibrosis Model

Unilateral ureteral obstruction was performed on Balb/c female mice (from Harlan-France), with 10 mice/group. On day 0, mice were anaesthetized by intra-peritoneal injection and after incision of the skin, the left ureter was dissected out and ligatured with 4.0 silk at two points along its length. The ureter was then sectioned between the 2 ligatures. Intact mice were used as control. Mice were sacrificed by exsanguinations with scissors under anaesthesia after 10 or 21 days.

9.3 Rat 5/6 NTX (5/6 Nephrectomy) Renal Fibrosis Model

Nephrectomy was performed on Sprague-Dawley male rats (from CERJ-France), with 10 rats/group. At Day0 rats were anaesthetized and after incision of the skin, the kidney capsule was removed while preserving the adrenal gland. The renal hilum was ligated and right kidney was removed. The ends of the left kidney are cut with a scalpel resulting in 5/6 nephrectomy. Rats were sacrificed after 4 or 8 weeks.

9.4 Mouse BLM (Bleomycine) Pulmonary Fibrosis Model

Lung fibrosis was induced on CD1 male mice (from CERJ-France) for bleomycin i.v. administration with 6 to 8 mice/group and on C57/B16 J female mice (from Janvier) for bleomycin i.t. administration with 14 mice/group.

For intravenous administration mice were injected intravenously (i.v.) with bleomycin (10 mg/kg; 100 µl/mouse) or saline as a control once per day for the first five consecutive days (Oku et al., 2004). Mice were sacrificed by exsanguinations with scissors under anaesthesia after 3 or 6 weeks.

For intra-peritoneal administration mice were anaesthetized by intra-peritoneal injection (under a volume of 10 mL/kg) of anaesthetic solution (18 mL NaCl 0.9%+0.5 mL xylazine (5 mg/kg)+1.5 mL ketamine (75 mg/kg)). Bleomycin solution at 2 U/kg or saline was administered by intra-tracheal route (10 mg/kg; 40 µL/mouse). Mice were sacrificed by exsanguinations with scissors under anaesthesia after 3 weeks.

9.5 Mouse Scleroderma Model

Scleroderma was induced on Balb/c female mice (from CERJ-France), with 15 mice per group. On day 0 mice were anesthetised by intra-peritoneal injection of a solution (Xylazine 5 mg/kg, ketamine 75 mg/kg) and shaved. A volume of 100 µl of bleomycin solution at 1 mg/ml or saline was injected subcutaneously with a 26 g needle into the shaved backs of mice. Bleomycin was injected 5 days per week for 3 consecutive weeks. The total experimental period was 6 weeks. Mice were sacrificed by exsanguinations with scissors under anaesthesia after 6 weeks.

9.6 Gene Expression and Regulation in Animal Fibrosis Models

At the end of the in vivo experiment, animals were sacrificed and tissues (1/2 mouse kidney for UUO model, 1/3 rat kidney for 5/6 NTX model, a piece of skin for mouse scleroderma model and 1 lobe of lung for mouse lung fibrosis model) were collected in 2 ml-microtubes (Ozyme #03961-1-405.2) containing RNALater® stabilization solution (Ambion #AM7021). Tissues were disrupted with 1.4 mm ceramic beads (Ozyme #03961-1-103, BER1042) in a Precellys® 24 Tissue Homogenizer (Bertin Technologies). Total RNA was isolated, subjected to recombinant DNase digestion and purified using Qiazol® (Qiagen #79306) and NucleoSpin® RNA kit (Macherey-Nagel #740955.250) as recommended by the manufacturers. RNA was eluted with 60 µl RNase-free water. RNA concentration and purity were determined by absorbance at 260, 280 and 230 nm. cDNA was prepared from 500 ng total RNA by reverse transcription using a high-capacity cDNA RT kit (Applied Biosystems #4368814). 5 µl of 10 times diluted cDNA preparations were used for real-time quantitative PCR. qPCR was performed with gene-specific primers from Qiagen using SYBR Green technology. Reactions were carried out with a denaturation step at 95° C. for 5 min followed by 40 cycles (95° C. for 10 sec, 60° C. for 30 sec) in a ViiA7 real-time PCR system (Applied Biosystems).

The following rodent β-actin primers (Eurogentec) were used: 5'-

```
(forward primer SEQ ID NO 176)
ACCCTGTGCTGCTCACCG-3'
and (reverse primer SEQ ID NO 177)
5'-AGGTCTCAAACATGATCTGGGTC-3'.
```

Mouse and rat assay mixes are listed in the table below.

TABLE 8

| Mouse and rat assay mixes (Qiagen) | | |
|---|---|---|
| TARGET | Mouse mix | Rat mix |
| MAP4K2 | QT01072365 | QT01611967 |
| PANK3 | QT00151823 | QT01586151 |
| PCMT1 | QT01052716 | QT00194978 |
| RHBDL2 | QT02522723 | QT01819405 |
| S1PR5 | QT00282744 | QT00376516 |
| SHPK | QT00143367 | QT01618141 |

9.7 Data Analysis

Expression levels of each gene were estimated by their threshold cycle ($C_T$) values in control animals.

The quantification of relative changes in gene expression were expressed using the $2^{-\Delta\Delta C_T}$ method (where $\Delta\Delta C_T = (C_T\text{target} - C_T\beta\text{-actin})_{diseased\ animal} - (C_T\text{target} - C_T\beta\text{-actin})_{control\ animal}$. Statistical analysis on $2^{-\Delta\Delta C_T}$ values were performed using unpaired Student's t-test versus control group (*: p<0.001; : p<0.01; *: p<0.05)

9.8 Results

All tested mRNA are well expressed in fibrotic tissues (kidney, lung and skin) (see Table 9)

TABLE 9 mRNA expression levels in intact animals

| | PANK3 | MAP4K2 | PCMT1 | RHBDL2 | S1PR5 | SHPK |
|---|---|---|---|---|---|---|
| Mouse UUO (10 days) | 21.3 | 22.9 | 22.5 | 27.2 | 29.8 | 25.2 |
| Mouse UUO (21 days) | 21.2 | 22 | 21.9 | 26.6 | 29.7 | 24.6 |
| Rat NTX (4 week) | 19.8 | 23.3 | 21.4 | 27.2 | 26.7 | 22.7 |
| Rat NTX (8 week) | 20.4 | 22.6 | 22.1 | 27.3 | 27.3 | 21.9 |
| Mouse BLM (i.v. 3 w) | 22.1 | 22.4 | 22.2 | 28.7 | 24.9 | 26.8 |
| Mouse BLM (i.v. 6 weeks) | 20.6 | 22.4 | 20.8 | 29.3 | 24.9 | 26.5 |
| Mouse BLM (single i.t.) | — | — | — | 31.5 | — | 27.8 |
| Mouse SCL | 22.2 | 24.6 | 23.3 | 24.7 | 25.2 | 27.2 |

(Ct > 30: low, 25 < Ct < 30: medium, Ct < 25: high)

Many genes are up or down regulated in mouse UUO model whereas only few regulations were observed in rat NTX model (4 & 8 weeks), and in lung and skin fibrosis models. (see Table 10)

TABLE 10 qPCR analysis of the fibrosis models

| | MAP4K2 | PANK3 | PCMT1 | RHBDL2 | S1PR5 | SHPK |
|---|---|---|---|---|---|---|
| Mouse UUO (10 days) | -2.8 *** | -2.7 *** | -2.1 *** | 1.5 (**) | ns | -3.7 *** |
| Mouse UUO (21 days) | -7.8 *** | -5.3 *** | -4.3 *** | ns | ns | -5.2 *** |
| Rat NTX (4 week) | ns | ns | ns | 2.1 ** | 1.8 ** | ns |
| Rat NTX (8 week) | -1.4 (**) | -1.6 (*) | -1.3 (*) | 2.4 ** | ns | -1.7 (**) |
| Mouse BLM (i.v. 3 w) | ns | ns | ns | 3.2 * | ns | ns |
| Mouse BLM (i.v. 6 weeks) | ns | ns | ns | 2.2 * | ns | ns |
| Mouse BLM (single i.t.) | | | 1.3 (*) | | -1.6 (***) | |
| Mouse SCL | ns | ns | 1.4 (**) | ns | 1.7 (*) | ns |

(fold > 1.8: significant fold induction vs intact animals;
fold < -1.8: significant fold inhibition vs intact animals;
ns: no significant change;
*** p < 0.001;
** p < 0.01;
* p < 0.05)

TABLE 11

Overview of the performance of fibroblast TARGETS in the primary screen, rescreen, and FMT validation assay.

| | Primary screen FIB scratch assay | | Re-screen FIB scratch assay | | Validation FMT assay | |
|---|---|---|---|---|---|---|
| | IQR | IQR | RobZ (neg) | RobZ (neg) | RobZ (neg) | RobZ (neg) |
| Gene | 1 | 2 | 1 | 2 | 1 | 2 |
| AK8 | 2.22 | 4.34 | 4.59 | 4.14 | -2.30 | -2.33 |
| AMH | 3.02 | 4.09 | 4.23 | 4.26 | -2.06 | -2.75 |
| CACNA1G | 3.14 | 3.25 | 4.21 | 2.14 | -2.78 | -2.56 |
| CAPN7 | 2.17 | 2.24 | 4.37 | 3.27 | -2.89 | -2.57 |
| CHPT1 | 4.32 | 2.07 | 2.51 | 2.84 | -3.12 | -3.39 |
| GMPR2 | 2.25 | 2.05 | 2.04 | 4.22 | -2.20 | -3.18 |
| KCNMB3 | 1.80 | 2.02 | 3.97 | 3.24 | -2.63 | -3.05 |
| MAMDC4 | 1.92 | 2.16 | 2.07 | 2.80 | -2.81 | -2.60 |
| MAP4K2 | 2.18 | 1.68 | 3.37 | 3.61 | -1.75 | -2.07 |
| PANK3 | 3.26 | 1.68 | 1.62 | 2.96 | -2.49 | -3.09 |
| PCMT1 | 2.51 | 2.65 | 3.55 | 4.29 | -3.75 | -2.16 |
| PRKAA2 | 1.75 | 1.83 | 4.09 | 1.27 | -3.59 | -2.55 |
| PTGIR | 2.68 | 2.79 | 4.01 | 2.06 | -3.20 | -2.62 |
| RHBDL2 | 1.89 | 2.01 | 3.75 | 1.36 | -2.46 | -2.24 |
| S1PR5 | 2.38 | 1.69 | 3.87 | 1.34 | -2.36 | -2.37 |
| SHPK | 2.22 | 2.19 | 6.83 | 4.65 | -2.55 | -3.22 |

This table gives an overview of the performance of the TARGETS. The first column shows the gene symbol of the corresponding target. Duplicate IQR-scores are shown for the primary fibroblast scratch screen, where a cut-off of IQR ≥ 1.5 was used and rescreen where a cut-off of robustZ ≥ 1.2 was used. Results of the FMT validation assay are shown with duplicate Z-scores where a cut-off of robustZ ≤ -1.8 was used.

TABLE 12

Overview of the performance of the shRNA contructs against the TARGETs in the on-target validation.

| Target | Sequence | SEQ ID NO | OT FIB scratch assay Z-score 1 | OT FIB scratch assay Z-score 2 | FIB CTB assay Z-score 1 | FIB CTB assay Z-score 2 | FIB nuclei count Z-score 1 | FIB nuclei count Z-score 2 | O.H. |
|---|---|---|---|---|---|---|---|---|---|
| AK8 | GGCCACCCGAATCTGAAAT | 129 | 6.2 | 9.7 | -0.69 | -0.82 | 0.72 | 0.61 | |
| AK8 | GGATGCTGAAGAGCAGGTC | 130 | 3.9 | 3.1 | -1.37 | -1.44 | 0.05 | -2.68 | |
| AK8 | ATACACAGTCTTCGAATAC | 131 | 5.2 | 2.7 | -1.11 | -1.26 | 1.09 | 2.58 | Y |
| AMH | AGACCTACCAGGCCAACAA | 132 | 1.7 | 1.8 | 1.05 | 1.11 | -0.55 | -0.67 | |
| AMH | CTACCAGGCCAACAATTGC | 133 | 2.8 | 10.4 | -1.37 | -2.04 | 0.43 | 1.79 | Y |
| CACNA1G | CAGCAGCCCATCATGAACC | 134 | 4.6 | 5.8 | -0.67 | -1.10 | 0.02 | 0.08 | |
| CACNA1G | GGGCGGCCCTTTATTTCAT | 135 | 1.8 | 3.5 | 0.30 | 0.94 | -0.41 | -0.42 | |
| CACNA1G | TGACAGTGAAGGTGGTGGC | 136 | 3.6 | 5.4 | -0.81 | -0.82 | -0.46 | 1.01 | Y |
| CAPN7 | GAATTAACAGCCCTCATTA | 137 | 5.5 | 6.6 | -1.50 | -1.11 | -1.28 | -1.03 | |
| CAPN7 | AATAGTATCGGATTGCTCC | 138 | 4.6 | 2.6 | -1.08 | -1.07 | 1.58 | 4.87 | Y |
| CHPT1 | GGCAAGAATGGATCCACTA | 139 | 2.4 | 2.7 | -0.48 | 0.59 | 1.73 | -2.11 | |
| CHPT1 | TGTGGGACTATACGATTCC | 140 | 3.0 | 3.0 | 1.35 | 1.66 | 0.57 | 4.42 | Y |
| GMPR2 | GAGCTGACTTCGTGATGCT | 141 | 4.5 | 1.6 | -1.74 | -2.13 | 1.19 | 1.21 | |
| GMPR2 | GAAGAGCTCATCCTTTCTG | 142 | 5.6 | 7.3 | 0.39 | 0.66 | -0.41 | -0.32 | |
| GMPR2 | TATAGCCTCGTTCAGTGGC | 143 | 8.5 | 1.8 | 0.50 | 0.89 | 1.57 | 4.29 | Y |
| KCNMB3 | CACAGATATCATGGACGAC | 144 | 8.3 | 4.7 | 0.59 | 0.91 | 1.96 | 3.83 | |
| KCNMB3 | TGACTCTGCTAGGTGGTGC | 145 | 5.5 | 6.5 | -0.74 | -0.74 | 1.85 | 1.06 | Y |
| MAMDC4 | GTGGCTCTGGATGATCTGC | 146 | 2.1 | 2.2 | 0.74 | 0.73 | -2.08 | -2.01 | |
| MAMDC4 | GATCGTGTTTGAAGCCACT | 147 | 6.1 | 4.3 | 0.29 | 0.60 | -2.22 | 2.75 | |
| MAMDC4 | TTACTGCTCCTTTGAGGAC | 148 | 1.9 | 7.0 | -0.28 | 0.02 | -2.69 | -2.23 | N |
| MAP4K2 | ATGAACTGCATGAGGATAC | 149 | 2.8 | 2.4 | -1.52 | -1.77 | 5.79 | 10.45 | |
| MAP4K2 | GGAATGACCGCTTGTGGAT | 150 | 4.8 | 4.3 | -0.13 | -0.33 | 0.54 | 0.53 | |
| MAP4K2 | GAAAGGAGTCTGACTATTC | 151 | 6.4 | 3.1 | -0.11 | 0.22 | -2.79 | -2.00 | N |
| PANK3 | GTAAAGGGCTTGCTGTATA | 152 | 1.8 | 4.5 | -0.74 | 0.31 | -0.23 | 5.94 | |
| PANK3 | GTGTGCTGTTAATGAGAAA | 153 | 5.2 | 2.9 | 0.67 | 0.70 | -2.25 | 6.54 | |
| PANK3 | TAACGTGGCATATGGATCC | 154 | 2.9 | 4.1 | 0.36 | 0.53 | 2.24 | 4.31 | Y |
| PCMT1 | GTGGTCTCACTCTTGGGAA | 155 | 3.1 | 1.8 | -1.34 | -1.60 | 1.68 | 1.68 | |
| PCMT1 | GTGATGCTGGCTACAGACC | 156 | 5.8 | 6.0 | 0.43 | 0.57 | 0.05 | 3.07 | Y |
| PRKAA2 | GCAAACCGTATGACATTAT | 157 | 2.4 | 2.4 | 0.08 | 0.17 | 0.21 | -0.46 | |
| PRKAA2 | GATAGCCGATTTCGGATTA | 158 | 1.9 | 4.3 | -0.09 | -0.26 | -0.08 | 0.25 | |
| PRKAA2 | GATTTGCCCAGTTACTTAT | 159 | 2.2 | 4.6 | -0.26 | -0.32 | -2.69 | -0.80 | |
| PRKAA2 | TGTCCTGTTGGATGCACAC | 160 | 2.3 | 4.4 | -0.09 | 0.19 | 0.79 | 2.41 | Y |
| PTGIR | TCATCCTCTTTGCCATGGC | 161 | 3.7 | 2.1 | 0.65 | 0.53 | 1.48 | 1.74 | |
| PTGIR | GTCGTCCAAAGCAGAAGCC | 162 | 2.8 | 4.1 | 1.69 | 1.40 | 2.79 | 6.02 | Y |
| RHBDL2 | GGAAGCCTGGAGGTTTATC | 163 | 3.4 | 2.9 | 0.47 | 0.87 | 1.28 | 1.74 | |
| RHBDL2 | TGGCTACACGGTGTTTAGC | 164 | 2.2 | 14.4 | -1.77 | -2.26 | 7.34 | 10.28 | Y |

TABLE 12-continued

Overview of the performance of the shRNA contructs against the TARGETs in the on-target validation.

| Target | Sequence | SEQ ID NO | OT FIB scratch assay Z-score 1 | OT FIB scratch assay Z-score 2 | FIB CTB assay Z-score 1 | FIB CTB assay Z-score 2 | FIB nuclei count Z-score 1 | FIB nuclei count Z-score 2 | O.H. |
|---|---|---|---|---|---|---|---|---|---|
| S1PR5 | AGAGATGGTGATGGTGGTC | 165 | 6.8 | 2.0 | -1.35 | -2.02 | 6.51 | 10.95 | |
| S1PR5 | CTTCATCGTGCTAGAGAAT | 166 | 3.8 | 1.6 | -0.69 | -0.08 | -0.65 | -0.91 | |
| S1PR5 | TTCATCGTGCTAGAGAATC | 167 | 1.7 | 4.1 | -1.23 | -1.62 | -2.24 | -2.74 | N |
| SHPK | GCAGGATGTGAGTAGAATC | 168 | 6.5 | 4.6 | 0.25 | 0.46 | 0.65 | 3.14 | |
| SHPK | GCAACCATCTTCTGGCTTT | 169 | 1.6 | 7.7 | 1.09 | 0.90 | -0.12 | -1.53 | |
| SHPK | GAGATACCCACCTGACCAT | 170 | 2.3 | 3.0 | 0.20 | 0.32 | 2.58 | 1.25 | |
| SHPK | TGATGTCCGACCAGAATGC | 171 | 18.3 | 4.8 | -0.02 | 0.10 | -0.12 | 3.07 | Y |

The confirmed candidate TARGET gene name and knock-down sequence of the adenoviral constructs are shown. Results for the shRNAs which were considered a hit are shown and in addition the shRNA that originally was a hit (bold), and the "O.H." column shows if this shRNA was a hit again in both on-target (OT) assays (Yes/ No). Duplicate results are shown for the fibroblast scratch on target screen with a cut-off of RobustZ ≥ 1.5. CTB results and nuclei count results are shown as duplicate RobustZ. Hits were included based on non-toxic effect in the CTB assay if RobustZ ≤ -5 and on non-toxic effect in the nuclei count if RobustZ ≤ -2.4. On-target indicates if at least 2 independent shRNAs including the original shRNA give the same effect. Nt is shown if the viruses were not tested.

TABLE 13

Overview of the expression of the TARGETS in on target analysis.

| | | Expression | | |
|---|---|---|---|---|
| Gene symbol | Gene class | EST per Million in lung | FPKM value, no trigger | FPKM value, trigger |
| AK8 | Kinase | 45.00 | 0.06 | 0.13 |
| AMH | Secreted/Extracellular | 5.94 | 0.03 | 0.08 |
| CACNA1G | Ion channel | 5.94 | 0.04 | 0.06 |
| CAPN7 | Enzyme | 26.71 | 8.77 | 11.01 |
| CHPT1 | Enzyme | 38.58 | 47.25 | 37.51 |
| GMPR2 | Enzyme | 71.22 | 43.73 | 33.43 |
| KCNMB3 | Ion channel | 0.00 | 0.27 | 0.31 |
| MAMDC4 | Other | 2.97 | 0.55 | 1.50 |
| MAP4K2 | Kinase | 29.68 | 5.13 | 3.05 |
| PANK3 | Kinase | 14.84 | 8.05 | 12.85 |
| PCMT1 | Enzyme | 97.93 | 72.16 | 38.65 |
| PRKAA2 | Kinase | 20.77 | 0.72 | 0.57 |
| PTGIR | GPCR | 5.94 | 3.04 | 4.52 |
| RHBDL2 | Enzyme | 17.81 | 0.89 | 0.57 |
| S1PR5 | GPCR | 5.94 | 0.05 | 0.10 |
| SHPK | Kinase | 8.90 | 4.02 | 1.86 |

The confirmed candidate Target Gene Symbols are shown with the corresponding gene class of the Target. Expression data is shown as EST per Million in lungs. Expression data obtained from RNA-seq is shown as an FPKM value of one normal human fibroblast donor, either non-triggered or triggered with TGFβ.

REFERENCES

Bethany B. Moore and Cory M. Hogaboam (2008) Murine models of pulmonary fibrosis. Am J Physiol Lung Cell Mol Physiol 294:L152-L160

Bostrom H, Willetts K, Pekny M et al. (1996) PDGF-A signaling is a critical event in lung alveolar myofibroblast development and alveogenesis. Cell; 85:863-73

Eickelberg O, Kohler E, Reichenberger F et al. (1999) Extracellular matrix deposition by primary human lung fibroblasts in response to TGF-beta1 and TGF-beta3. Am J Physiol; 276:L814-24

Gabbiani G. (2003) The myofibroblast in wound healing and fibrocontractive diseases. J Pathol.; 200:500-3

Kohan M, Puxeddu I, Reich R et al. (2010) Eotaxin-2/CCL24 and eotaxin-3/CCL26 exert differential profibrogenic effects on human lung fibroblasts. Ann Allergy Asthma Immunol 2010; 104:66-72

Lipinski C A, Lombardo F, Dominy B W, Feeney P J (March 2001). "Experimental and computational approaches to estimate solubility and permeability in drug discovery and development settings". Adv. Drug Deliv. Rev. 46 (1-3): 3-26.

Pierce E M, Carpenter K, Jakubzick C et al. (2007) Idiopathic pulmonary fibrosis fibroblasts migrate and proliferate to CC chemokine ligand 21. Eur Respir J; 29:1082-93

Puxeddu I, Bader R, Piliponsky A M et al. (2006) The CC chemokine eotaxin/CCL11 has a selective profibrogenic effect on human lung fibroblasts. J Allergy Clin Immunol; 117:103-10

Scotton C J, Chambers R C. (2007) Molecular targets in pulmonary fibrosis: the myofibroblast in focus. Chest; 132:1311-21

Starkel P, Leclercq I. A. (2011) Animal models for the study of hepatic fibrosis. Best Practice & Research Clinical Gastroenterology, Volume 25, Issue 2, Pages 319-333

Todd N W, Luzina I G, Atamas S P (2012) Fibrogenesis Molecular and cellular mechanisms of pulmonary fibrosis Tissue Repair. vol 5: 11-35.

Wynn T A. (2008) Cellular and molecular mechanisms of fibrosis. J Pathol. 2008; 214:199-210

Wynn T A. (2007) Common and unique mechanisms regulate fibrosis in various fibroproliferative diseases. J Clin Invest; 117:524-9.

Wynn T A. (2004) Fibrotic disease and the T(H)1/T(H)2 paradigm. Nat Rev Immunol.; 4:583-94

Zeisberg M, Mary A. Soubasakos, Raghu Kalluri (2005). Animal Models of Renal Fibrosis. Fibrosis Research. Methods in Molecular Medicine, Volume 117, pp 261-272

SEQUENCE LISTING (177 sequences)

SEQ ID NO: 1 - DNA, 2351 bp, Homo sapiens
ctcactcggttcaaggcagcgcgactgcgggtggcgcacgaccagggcgcagaccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttcttttctttctttctttcttttttttttttttgagttgggatcttgtgctctgtcacccaggctggagtgcaatgggcacaattatagctcactgcagcctggaactcctgggatcaagcctggagttcctgcttcagcctccctagtagctgggactacaggcatgcaccaccatgcccagttaataaaatttcttcaaatgcaaaaaaaaaaa

SEQ ID NO: 2 - DNA, 2467 bp, Homo sapiens
aattgggaggggcctgtgcccgggagcagcgggaacctatctgctggtgggagaggactcaggctaaggtggcccccactgaagactcctgctaagcaacccactgaagacccctccgaatcatcgacggggcgtccttggggtgcagcccaggaagctcagttcacagccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttcttttctttctttctttcttttttttttttttgagttgggatcttgtgctctgtcacccaggctggagtgcaatgggcacaattatagctcactgcagcctggaactcctgggatcaagcctggagttcctgcttcagcctccctagtagctgggactacaggcatgcaccaccatgcccagttaataaaatttcttcaaatgcaaaaaaaaaaa

SEQ ID NO: 3 - DNA, 1838 bp, Homo sapiens
agagcgggatcttcagggcagcgggcaaccccttggcccaggaagcctggaacgcaaggaccggagggcgtgggctgggacgcccctaccttggtctttcagggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaagaagaagagagaaaagaagggtagtaaaaactagagattggggccaggcgcagtggctcacgcctgtaatcccagcactttgggaggctgaggcgggtgaaatcacctgaggtcatgagttcaagaccagcctgaccaatatggtgaaaccctgtctctactaaagaaaatacaaaaattagccgggcgtggtggcgtgtgcctgtagtcccagctacttgcgaggctgaggcaggagaattgcttgaacctgggaggcgaaggttgcagtgagccgagattgcgccactgcactccagcctgggtgatagagcgacactcggtctcaaaaaacaaaacaaaacaaaacaaaattagagattgggtctttcccaggcatatggtattctataaaacagacttactctccttggaggatatattttggagaatgcttcataaaatctatgaatactgtacaatgctgataataaaaactttttatacctga

SEQ ID NO: 4 - DNA, 2971 bp, Homo sapiens
cagagccacgggcgcccgccccgccccgcgccgccccgcgccggctccgcagctcgcgcccgcccgcctgccggcccgcccggcgccgggccatggcgctgctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagaggcactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgttttaaaaaaaaaaaaaaaaa

SEQ ID NO: 5 - DNA, 3838 bp, Homo sapiens
gattggcaggcgactccccgcccctgccccgcccccctgggcgaagagcgcggacttgtggggccgctggctgcagactggagctgcgcgggtcagggagataatggctgcgcggccgatcaccctcggcattgacctgggcaccacatctgtgaaggcagctctgctgagggccgcgcccgacgacccatccgggttcgcagtgctggcgagctgtgcccgtgctgcgcgggcagaggcggcggtcgagagcgcggtggccgggccccaggggcgggagcaggatgtgagtagaatcctccaagccctacacgagtgccttgctgcccttccccgaccccagctccggagcgtcgtgggcatcggggtgtcgggccagatgcatggagtcgtgttttggaaaacaggccaaggctgtgaatggacagagggagggattaccccggtgttcgagccccgagctgttagccacctggtcacgtggcaggatggccgatgtagcagcgaattcctggcctctctgccccagccgaagtctcatctcagtgtggccacgggcttcggctgtgcaaccatcttctggcttttgaaatatcgcccagagttcctgaagtcctacgacgcagccggtaccatccacgactatgtggttgccatgctgtgtggcttgccaagacctctgatgtccgaccagaatgctgccagctggggctatttcaacacgcagagccaaagctggaacgtagagacactgaggagctcgggttttcctgtccacctgctcccagacatcgccgagcctggcagtgtggcgggcagaacttcccacatgtggtttgaaatcccaaaggggacgcaggtgggagtggccttgggtgatttacaggcctctgtctattcctgcatggcccagaggacagatgcagttctcaacatcagcacctcggttcagctggcagcctccatgccttcaggattccagcctgcacagactccagaccctacggccccagtcgcctacttcccatacttcaacaggacctacctgggggtggccgcgtcactcaacgggggcaatgtgctggccacgttcgtccacatgctggttcagtggatggcagatctaggcctggaggttgaagaatccactgtgtattcacgcatgattcaggcagctgtgcagcagagagatacccacctgaccatcaccccgacagtgctgggggagaggcacctgccggaccagctggcctcagtgaccagaatctcctcctccgacctctccctggggcacgtgacccgggctctgtgccgaggcattgttcagaacctgcactccatgcttccgattcagcagctccaggagtggggcgtggagagggtgatgggcagtgggagtgcgctgtccaggaatgacgtgctgaagcaggaggtgcagagggctttccctttgcccatgtcctttgggcaggatgtggatgcagctgtcggggcagctctggtcatgctccggagacacctcaaccagaaggaatcttagacagcaaactctttcgccaaacgactgctgtgaattttacctgattaacattcctgacaccatctgtgggtcatcctttccctggaccgttcagtggacagctttcaagcagtgcttgttgtgaggtcccatctcggccaagaacttaccttcagaacatactctaataatgcagccaggagccgtcagccagatcccaaatgagtgccttccgaaattgacccacctgggagctatttacaaatgtccatgtgggagagagagagcatgagagcacagtagcccagcctgctggtcagcaggctcatctgtggttcacctgtagacagagagcagatcaatgtgtacttcagacaccagaaagtctggtggctttggtcccaagtgggaaaagagaactgccccatgcccagcttgtgattatcgtttttggagacctgaagcccacactcgggtcgtatggacttctggaaaagttcttgtctcctggactgaaccatgtgaccggaggcccctttcctagtctcatcctcccctggctgcagatgcttagctgggccagggattgacccaagcgcgatgcagcaggcaggctcagaagacgatgcggggctgtgtgccggccttcttgctgcatgtactcagcctcaggagagcttgctgcacccaggccgcccaggtcttcacagcacaactgcctggaaggcaggttgcgagaaggagaggcggatggcatgagcagcaagggggaccgatgctgtgcagctcacaccactccagaacctgacaaggcaccagcaggaccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctctctcagtatccatgacaggtatgaaacatattgtctctttataaatgtcattttacaaattatgtgattatctggaagctctaagatgagagcaaatgcctgatcactctggccaaatgtcagatactaaagcccattcttggccgggcatgttggctcccgcctgtaatcccagcactttgggaagcccaagtgggtgaatcacctgaggtcaggagttcaagaccagcctgaccaacatggggataccccgtctctactaaaaatacaagccgggcgtggtggcgcatgcctgtaatcccagctactcaggaggctgaggcaggaaaatcacttgaactcgggaggcagaggttgcagtgagctgagatcgcgccattgcactccagcctgggtgacagagcaagactctgtctcataaataaatacaaagcccattcttccagagtcttgtgccttaaataaaacacacctctctgctgtgggaagactgtgcaatggcacagccgcagagcttggtttgggaggttgaagtgctctggggagaattcgtagatcatcctcagaaaagccttgccctggtgttctaccagaaaaacgtctcccaatcacccaggaaagctgtccacagtagtccccccttatccacggtgtcactttccatgggttcagttatctgcggtcaaccacggtctgacaatattaaatggaaaattcttcaaacagttcccaagttttcccttgtgcattgttctgagcagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggtcagtctttttttacttcattagggccccaaagcaccagagtagtgatgctggtagtgatgctggctgttcggatatgccaaagagaaaccgtaaggtgcttcctttaagtgaaaagatgggaagaaaacagtcatatgctgaatcttctatctgtgaaattct

SEQ ID NO: 6 - DNA, 3404 bp, Homo sapiens
tttctcagtgcggcggcggcggcggtggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggaggaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaaatgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaaaaaaaaaaaaaaaaaaa

SEQ ID NO: 7 - DNA, 2185 bp, Homo sapiens
cttggccagagccggggagctgggaggggtctaccggggctcgactctaggagttgggctgaggatttccacccgatcctcgaacctccggcccatctcatggacgcccctcccccttcaaacaccctcccccacatttattcccgcgtctgttttaaagatgggtaaactgaggcacagggagccgggccggggagcactgacagaaccagaagcaggttctgcctcccgtcccctcggagggccgacttgccccttctgggtttcgtcgggggtctcagatacgaggaggcccagctggaagccacctgagggtgtcccccgctaagatgcgcaaatgggaaaagcgaggccggggttggggaaagaacttgcccgagccgcagagcgcgtcagccggggaggtcggggcgggggcgacccgcgcgaccgaggatcgggtatctgggcccggcgcggagcctgcagggcggggccgcggcgcgtgctgatgacgcagtcggcgcggcggccctagcgacgcggttactagggagcggcgagccgagacggctacatggacgccactatcgccccgcaccgtatcccccccgagatgccccagtacggggaggagaaccacatcttcgagttgatgcagaacatgctggagcaactcctgatccaccagcccgaagatcccatccccttcatgatccagcacttgcatagagacaacgacaatgtgcccaggattgtaatattaggtccacccgcctcagggaaaacaacaatagcaatgtggctctgcaaacatctgaacagcagtctcctcaccctggagaacctgatcttaaatgagttttcctatacggccaccgaagccagaaggctttatctgcaaaggaagacagttcccagcgcgctgctcgtccagctgattcaggaacgcctggctgaagaggattgcatcaagcagggctggattctggatggcatccctgagacgcgtgagcaggctctgaggatccagaccctggggatcacacccagacacgtcattgtgctgagtgctccagacacggtcctgatcgagagaaacttggggaagagaatcgaccctcaaactggagagatttatcacaccacctttgactggccacccgaatctgaaatccagaaccgtctcatggtgccagaggacatctcagagctggagacggctcagaaactgctggagtatcataggaacatcgtcagggtcattccctcctaccccaaaatcctcaaagtcatcagtgctgaccagccatgtgtggacgtcttctaccaggctctgacctatgtccaaagcaaccatcgtactaatgccccgttcaccccgagggtgctgctgctcgggcctgtgggcagtgggaaaagtctgcaggccgccctcctggcccagaaatacaggcttgtcaatgtctgctgtgggcaactgctgaaagaggctgtggcagataggaccacgtttggcgagctcatccagcccttctttgaaaaggagatggcagttcctgacagcctcctcatgaaggtgctgagccagcgcctggaccagcaggactgcatccagaaaggctgggtgctacacggcgtcccgcgggacctcgaccaggcacacctgctgaaccgcctgggctacaatcccaacagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctgatgggttcagagccaggagcgctgccccagggaaagagttaatcccctgcccccagccccccagcctcggcacagctcccctaaaaagccaataaagcctgctggatacagaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8 - DNA, 2065 bp, Homo sapiens
gcatgttgacacatcaggcccagctctatcactggggagggagataggctgccagggacagaaagggctctttgagaaggccactctgcctggagtgggggcgccgggcactgtcccccaaggtcgcggcagaggagataggggtctgtcctgcacaaacaccccaccttccactcggctcacttaaggcaggcagcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcagcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccagagcctctgcccctcccgagacacccgctacctggtgttagcggtggaccgccctgcgggggcctggcgcggctccgggctggccttgaccctgcagccccgcggagaggactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggcccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggcaaaaaaaaaaaaaaaaaaaaaaaaaaaaaaaaaaaaaaaaaaaaaaa

SEQ ID NO: 9 - DNA, 4385 bp, Homo sapiens
gggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccggcataatttaccctcaaaacaaggatggtgaaccagaatacaatccatgtgggaagtatatggtaaaacttcacctcaatggtgtcccaagaaaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactaaaaaaaaaaaaaaaaaa

SEQ ID NO: 10 - DNA, 1567 bp, Homo sapiens
cgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgctta

SEQ ID NO: 11 - DNA, 1872 bp, Homo sapiens
tcgccaacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaaaaaa

SEQ ID NO: 12 - DNA, 1956 bp, Homo sapiens
gcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgaggttagttgctaagcaaggtggtctttggtcaactgccgcctggaccaaggcaacaggaaccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaaaaaa

SEQ ID NO: 13 - DNA, 1897 bp, Homo sapiens
gcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaaaaaa

SEQ ID NO: 14 - DNA, 1631 bp, Homo sapiens
tcgccaacattccttcgttcccctaaatcagcctcttgccccattgctctttgcaggggtagaagaaggaagtgtagcgggccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaaaaaa

SEQ ID NO: 15 - DNA, 1272 bp, Homo sapiens
gctcccggctgccgaggcggaaacacaggtgatgaggtggcggcaagcacagtgcaaagagagagaagcagcttcggctgcagcaaaccacgcaggtccttcttgatcatctagaactgaccgctccgccttgccaggagtctgcagaaccacgtggctagcctgcctgaagttctcacctctccaggaaggcggggggcttctaatggctgcagctgcgctgggggctgggggctcccgctgggactccacttccgtggatgtctaagcttcacctttcttgcgcccgcaggggcatgactcaggtgaaagggagccattttctcagacccctggcctcatgcagcccttcagcatccccgtgcaaatcacacttcagggcagccggaggcgccaggggaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggta

SEQ ID NO: 16 - DNA, 1856 bp, Homo sapiens
gttcctggttctccagcaggaactgagagcaagggtcaggaggcgacaggtccaagtacagtagacactcaaagtgaaccctcagatatgaaagagccagatgaagaaaagaatgaccaacagggagaggcattggactcattgcagaagagaaagaacaagaaaaagaaaaagaagaggaaaaaatccccagtacccatagaaacccttaaagatgtttaaaaagagttaacttatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccagagaatcctaaaatgaagttggatggaaaacttgaccaagaaggcaatgatgtaaaaacagcagctgaggaggtactagctggtagagacacattagattttgaggatgtcacagttcaatcatcaggcccgagggctggtggtgaagaattagatgaaggtgttgcaaaagataatgctaaaatagctggtgccacttaaagcaatcctgaagaaccagagagcgaagatgcagatcactgcaccgtacccaaaaatgaaagtccctcacaggacattagtgatgcctgtgaagcagaaagtacagagaggtgtgggatgtcagaacatccaagtcagaccatcaggaaagctttagacagcaatagcctaaaaaaccatgacttgttggcaccaggaggagagccgggggacttcaatccagaaagcagagaagataccagaggagggaacgagaagggcaaaagcaaagaagaccgtaccatgtcctaagctgaggcaggcggcaggcgtggtgcacaggaagtctgagtgtgaggggctcttttctctccactgccaatgacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaatttaaaa

SEQ ID NO: 17 - DNA, 1835 bp, Homo sapiens
cccagctactagggaggctgaggcaggagaatcgcttgaacctgggaggcggaggaggttgcagtgaactgagatcgtacccagcctgggcaacagtgcgaggttccgtctcaaaaaaaaccaaaaaacacaaaaacaaaaaacgacagagaaggccaaacaaaacacatctgtgggctggatgccgccatgcccaccggtttgcgacctttgtgttggactcttctgttcaccagacaccctgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttccatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggtaggcagcaaatgagattatccctccagtccccatggattggaaatgttcccccttctttatgagctcactgcagtatctccttctccctttccccaaaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaatttaaaa

SEQ ID NO: 18 - DNA, 1492 bp, Homo sapiens
tgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttccatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaatttaaaa

SEQ ID NO: 19 - DNA, 1123 bp, Homo sapiens
gctcccggctgccgaggcggaaacacaggtgatgaggtggcggcaagcacagtgcaaagagagagaagcagcttcggctgcagcaaaccacgcaggtccttcttgatcatctagaactgaccgctccgccttgccaggagtctgcagaaccacgtggctagcctgcctgaagttctcacctctccaggaaggcggggggcttctaatggctgcagctgcgctgggggctgggggctcccgctgggactccacttccgtggatgtctaagcttcacctttcttgcgcccgcaggggcatgactcaggtgaaagggagccattttctcagacccctggcctcatgcagcccttcagcatccccgtgcaaatcacacttcagggcagccggaggcgccaggggaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagcgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacaggacttcaattcactgaatgacaaaatatagagaaataaacttgctacaattaatgggaaaaaaaaaaaaaa

SEQ ID NO: 20 - DNA, 3669 bp, Homo sapiens
ggaacttcccaggcaccctgtgtggccgcactgctccctctggcccaaccatgcctctgtccagccacctgctgcccgccttggtcctgttcctggcagggtcctcaggctgggcctgggtccccaaccactgcaggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggctggtacatggccgttggaacccaccgagggaaagaggcatccaccgcagccctgcgctcgccaaccctgcgagaggcagcctcctcttgcaagctgaggctctggtaccacgcggcctctggagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgcgctggtggtcctgagcgcccctcctggccacgccgtgaccacagccggaacagtgcacagggctccttcctggtctccgtggccgagcctggcacccctgctatactctccagccccgaattccaagcctcaggcacctccaactgctcgctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggtggtgtttgaggcagtggccgcaggcgtggcacactcctacgtggctctggatgatctgctcctccaggacgggccctgccctcagccaggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaaaaaa

SEQ ID NO: 21 - DNA, 1751 bp, Homo sapiens
gcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggcaaaaaaaaaaaaaaaaaa

SEQ ID NO: 22 - DNA, 1704 bp, Homo sapiens
gcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggcaaaaaaaaaaaaaaaaaa

SEQ ID NO: 23 - DNA, 1646 bp, Homo sapiens
gcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggcaaaaaaaaaaaaaaaaaa

SEQ ID NO: 24 - DNA, 1646 bp, Homo sapiens
gcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcagtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggcaaaaaaaaaaaaaaaaaa

SEQ ID NO: 25 - DNA, 1599 bp, Homo sapiens
gcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggcaaaaaaaaaaaaaaaaaa

SEQ ID NO: 26 - DNA, 1065 bp, Homo sapiens
gcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaaggtgaaagggtgtggattttaagacattagactacaagagctgtttttggttgtcacctttatgctcctccattataacgtcagaaattcattacattaaaaatgtgaaaaatgttaaaaaaaaaaaaaaaaaaaaaa

SEQ ID NO: 27 - DNA, 9369 bp, Homo sapiens
ctgtgggtaggcggcggcggcggcggctacgcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagattggagaacatcaattaacaggccataaagtggcagttaaaatcttaaatagacagaagattcgcagtttagatgttgttggaaaaataaaacgagaaattcaaaatctaaaactctttcgtcatcctcatattatcaaactataccaggtgatcagcactccaacagatttttttatggtaatggaatatgtgtctggaggtgaattatttgactacatctgtaagcatggacgggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggattatctaatatgatgtcagatggtgaatttctgagaactagttgcggatctccaaattatgcagcacctgaagtcatctcaggcagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataagagagcatgaatggtttaaacaagatttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtagtgaatgcataccatcttcgtgtaagaagaaaaaatccagtgactggcaattacgtgaaaatgagcttacaactttacctggttgataacaggagctatcttttggactttaaaagcattgatgatgaagtagtggagcagagatctggttcctcaacacctcagcgttcctgttctgctgctggcttacacagaccaagatcaagttttgattccacaactgcagagagccattcactttctggctctctcactggctctttgaccggaagcacattgtcttcagtttcacctcgcctgggcagtcacaccatggatttttttgaaatgtgtgccagtctgattactactttagcccgttgatctgtctctagtttctttctgttattgcactatgaaaatcagttatattctttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctatgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcccccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacacaaactatagcagggtagataatagtttattgattatattttgttttagtaaaagtatttaattttaaattctgtgtaatttatctaatttgtatttattcatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggcaccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataaggaactaatcagattacttaaccccaatgacaaaatccacaaaaattttgaaggcagagaaacagaaggaatccagtgatgttttagctccattagtctaataggtcagatattaaaaaattgttcatatcaaaattaccttatatggattattgccatgttttttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaagagcttctattatgaggttatagataaggccttagttatatcatggaaatggactccatgtagttctagaactgcatttcccaaagtatatcctgtgagatgctccacagaaaaaatgattgcatggactaagtttgaaaaatgttgcatgctactcttcccctcgaagatgacagtggatgtcagcattaaagactttgacaggtctttctgtgaaaaaaagaaagccacataactttgttgaactttgcccaaattaatttttcattttaaaaaacttaatagcccatgaaaagcaaatttgggaaatacattttttaggaaaatactgtcccagaatgccataattagggtagttaataattaacacttccatttctcttactggttgttgggagaatctgattgaaaattagaattactttgttttaacttgcagacatgttcatcgtgagtgaatgctggattaaatagaattttctgtgtctgcaacttgtttcatgacaccttggttttcttaatcatcttgtattattatttgagtgcaacattattcttatgcatgggtgactgaaaaacctgaaacaagattacttgttaaaaaaaagtctaagagactaatgactcatgcttatggctcagtgggtaatgaatcagtgtcactgattcttacttttaaaatgtgtagtcagtgaacattttctaaatacttttctttgggataccatatgaagatctaattccttatgtttcagtgtaggaacagctaccttctcaaatagaatatgcagggagggaagtaggcaaaccatttacaagttgggtttttgttttgattaacctgttaagagacacttttgtaatctctagtgtttacattcctttatactagctatctataaagagaatccagaaggctaaattaatcagaaataattatatttctatgtcagggtattggctatatgtagcatgaacaattctccattttctgcaaatgggtttttcaggacagttttataattctgagtttgctttttcttattccctagacagtttgtactcagggaatacaaattgatttttactgttaaatgagacatagtttagaaaaaatcataagcaactattgtagatttttgatctgtttggatttatctgtagcattgaataatgtgcagtgtactgagttaatgtaggcacctcactttggatttataaaatgtaaaaacctggaacatgcctgccacagacaccactttgtctattcaccgggtactaatttacatcctattaatggttgtaaaagctgagtgtctaaatgctagacatgttcacaattttgtctgtttttgtttatttgtttttaagacccaaaccttttcaatcttgcatttatttacttggttctcctgtgtcaccctgtggctttttaaatagggaatgtaatttattttaatagtagttctcaaagactctattaaaaactctggacgagggatatgtgcaatctgttggtaagtcacatcctatgtttggcctcatttttataactcctaaaatgagaaaggtagattttaacacttctaaggtacctttgagctttaaagttcttttctgcttttccatatgatttgtgttagtgttcactttttatatatttagagtttttatatgagtgtgaatgtttctgttttgatttggtgaggcatgtcagaggtatatacttgaatatttttctaaatacagctgctggaggaatgcaaatggcaaaaatcatccagaaaaccaaacacggtgaaacatcacatccatttggcatgaagcaaagcattacaaatttggagtgatgaaagtgttccatatattttttatagtgatttttcgatctagagacccttcatattgtttacttactattacgataactttgagaggtaaccagagaaagcatttttgccatttccagatgaggaagcaggaccagaaagctcttcataaagctttaacaccatacaagtatccagcagtgatcaattgctctttataggaaaccacctttcctctggggaagaacagtctgaattaataaaacatcagagtggttgagtagtaaaaataaacacagatgtattgctttcaagtcttagagtgacataaagtagtcttaaataaatagttcttagtttattttaagcagttgattgtactaacgagatgtaattatctgaagtatttatgattagcatattggtttttataagtatttctgagttattgagggtgcttaaaaatgctgaagaaactttaaaacatgattcttcttataattttatgtgattcttatagcacaatcatttttgaaaaaggaaaactaggctgggtgtagtggctcatgcctataatcccagcactttgggaggccaaagtgggtggatcacccgagttcaggagttcgagaccagtctggccaacatggtgaaacctcgtctctactaaaaataccaaaattatccggtgtggtgacaggctgcttgtaatcccagctactcgggaggctgaggcacgggaatctcttgaacctgggaggcagagattgcaataagccaagatcatgccactgcatgccagcctgggtgacagcacaagactgtctcaaaaaaaaacaaaaaaaggaaaaagaaaactagccccagtccctgtctaaattgttatagtttttgactattatctgaattagtcttatccaaatttcatatgcagattgatttttcattttgtatgtatattacatgatataactattttcatagaatatatttctaatttacaaacactgaattattagcttgatagagtttctcccaaaccttataaaactttgaaatgtacttatgtttgagctttaaaaattataaaaacttcatttaaacaagttgctggcatcattactagcctttccacctataattatgatgcatttgatgccactgaacagtaatagcacaaagaacaggtcacacagtctagactggattgagttttaattaaacttcttcatccatagcctgataagaatcaggctgggtctagaagagttatcagactgtaggcctgtattaattttgcaagctaatgttaatgtttactgccagccttgcatagcaatgccagtttgcagttgtgactatgatgtgacttttggtaaaaatggtttatatctaaagtagtttagattttatggaagtggctcttgattgtttggacaagcagggtaggtaaatttcaattacgtttgaagtgtaattaaatcctagaatagagcactctccagaaaaaaaaatgaaaaaagaatttggagaatatcctggcatgaaaacttttttgaataatacgtagaattttgacaaggttcatacagtgcatacagtgtgaccttttctgaggtgggcagggagggttgctacgttgtgttgatttaaaatttcaaggaggaacaaaaacattctagccaaggagaattgcattgttatttttttttctactaatttaaacgtgcatttttcacagttacacatttaagttttgctaccaaaaatggccatttttctagacagataacattttcctaaagtggaagagagatccactgttctaaaaaaaaaaaaaaaaaaaaacactaaattgtgccttctcccttaaattataagaagagtaatagtaaaaacttgtttaaactatattttctttttttctaatccctctcagttctccttagatctgcctcctacaaatgatcatgttgtttgcatctgcctgattgagttcccttggtcaaacctctccctatcactatcagaagttgttcactaaatgtattttcctatttctttcatgttgattgactttataagtcaccttggtaaacataacatttggctaccttctcatgctttataaatgaatttgatgaatggcagtttttatattttaaccctttaaaaagtttgtcaaggaaacaactcagagctaagaacaaaatctaacttggaatcagtttcttcctttggctgctgaagcagcagcaagtcacgtaacctcatttagttttttgatttacaaaatgtggataataacctacctcacagatgtgtgtgagcaactgtttgaaagcccttgtttaaatacagggtttatatccccacattcaatgtaaattcctttttttaaaaaaaataagtatctttgatactgataggatgagtatcttgatttttaggtaagatcacagtttcacaaattgtggtgttgttaggtgacatttaatatttcttgagacctcaagtattcaaatatcaaacttgtcctgtgttgtaacaaatattcagaatctcttaaaatgttggctgaagctgccttaatgtaccaaaatacagctctcaagactgttcacaaatatctgtggttgtacaatgttttgaacatttaatgtaaagttgttgtagaactgtgaactctaaggatagtatctttattgttttaggaagaatggttgtgttctttgtcatgtatgcttaaatatacagtggattttgaatgcaacaaataaaactgaaaacagccatttggttgtgtcatgacaatcataatataggatataatatttactttttttcaaaaacatcctgcattcattcattcttagcatacctttgaaaaagaaaaaaaaatccataggttgatacattgacccattgaagtacttcattacgtatttattgaaaattttttttaattgttgaaattgggaccactttttataattggtttcaagaaaaaaaaatgaacagacttccagtgcttttctgttcaaataaactccgattcaaatttcagttttgtttgttatatactttttgtgagtgttaaatgatatgggaaggatttgtctttcattaaccatatggaaaagatgtcttcctgaattacatagcatttcatagttacagattcttcctaattaatgtttgcaccatatgaaactcataggtaacaaacacaaaggagaaaagcagcctgtctgattgcttataagcttttttcacaaaatcaaattaaaagtctctgattcatttgaaagctaaaaaaaaaaaaaaaaaa

SEQ ID NO: 28 - DNA, 2103 bp, Homo sapiens
aagctgacacacagaccgacacaggcagcgagagacacgaggagcaaagcaagtgaaggcacagacgcacgggacaggagagcctgggcaagactggagagcccagacctgggatggcggattcgtgcaggaacctcacctacgtgcggggctcggtggggccggccaccagcaccctgatgttcgtggccggtgtggtgggcaacgggctggccctgggcatcctgagcgcacggcgaccggcgcgcccctcggccttcgcggtgctggtgaccggactggcggccaccgacctgctgggcaccagcttcctgagcccggccgtgttcgtggcctatgcgcgcaacagctccctgctgggcctggcccgaggcggccccgccctgtgcgatgccttcgccttcgccatgaccttcttcggcctggcgtccatgctcatcctctttgccatggccgtggagcgctgcctggcgctgagccacccctacctctacgcgcagctggacgggccccgctgcgcccgcctggcgctgccagccatctacgccttctgcgtcctcttctgcgcgctgcccctgctgggcctgggccaacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctcagggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctggggccgatcagctgctgtttctcctgcggcagggcagtcgctgctggctctgggaagagagtgagggacagaggaaacgtttatcctggagtgcagaaagaatggttctctcaaaataaccagtggcctggccgacctgctctggccctggattccccatccatctcattgtctaaatatttagaaggcggagaagttcccagaggcttctgtacagtcaggtctgctctggtctgggtgctggctccaatctgcgtccacttaggaggcccaactgcccaccccaagtccccaggggatggccctccccctctaccaagccactccaagagccagcccctttctgctccacaaaaaccacagttattggaaaagctccctgccttcccttgccgctggtcccccaccaggcttgggagccctggcatcccaaaggggcaacgggaggaaggggaggctgctgcattgtgggtgatgacgtaggacatgtgcttggtacaaaaagggcctgagacattccacctagcttgactggctgcaagatgagaactgggggggtgcaggtggtggggagacagatggagaagctggcagatgaagggtgggggctgcggatcccagggactgccccagaacacaaacctaagtcctgtgcctgtccccagggtcctgaataaataaaagcctccttgcagagcctgaaaaaaaaaaaaaaaaaa

SEQ ID NO: 29 - DNA, 8264 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 30 - DNA, 8231 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 31 - DNA, 8162 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 32 - DNA, 8129 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 33 - DNA, 8096 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 34 - DNA, 8051 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 35 - DNA, 8027 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 36 - DNA, 7985 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 37 - DNA, 7952 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 38 - DNA, 7931 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 39 - DNA, 7916 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 40 - DNA, 7883 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 41 - DNA, 7862 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 42 - DNA, 7646 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 43 - DNA, 8075 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 44 - DNA, 8006 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 45 - DNA, 7994 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 46 - DNA, 7964 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 47 - DNA, 7910 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 48 - DNA, 7883 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 49 - DNA, 7850 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 50 - DNA, 7829 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 51 - DNA, 7814 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 52 - DNA, 7748 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 53 - DNA, 7715 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 54 - DNA, 7904 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 55 - DNA, 7877 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 56 - DNA, 7871 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaaaaaaaaaaaaaaaaa

SEQ ID NO: 57 - protein, 398 aa, Homo sapiens
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 58 - protein, 398 aa, Homo sapiens; identical to SEQ ID NO: 57

SEQ ID NO: 59 - protein, 303 aa, Homo sapiens
MAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAGVQHILGNLCMQLVLGIPLEMVHKGLRVGLVYLAGVIAGSLASSIFDPLRYLVGASGGVYALMGGYFMNVLVNFQEMIPAFGIFRLLIIILIIVLDMGFALYRRFFVPEDGSPVSFAAHIAGGFAGMSIGYTVFSCFDKALLKDPRFWIAIAAYLACVLFAVFFNIFLSPAN

SEQ ID NO: 60 - protein, 820 aa, Homo sapiens
MALLRDVSLQDPRDRFELLQRVGAGTYGDVYKARDTVTSELAAVKIVKLDPGDDISSLQQEITILRECRHPNVVAYIGSYLRNDRLWICMEFCGGGSLQEIYHATGPLEERQIAYVCREALKGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 61 - protein, 478 aa, Homo sapiens
MAARPITLGIDLGTTSVKAALLRAAPDDPSGFAVLASCARAARAEAAVESAVAGPQGREQDVSRILQALHECLAALPRPQLRSVVGIGVSGQMHGVVFWKTGQGCEWTEGGITPVFEPRAVSHLVTWQDGRCSSEFLASLPQPKSHLSVATGFGCATIFWLLKYRPEFLKSYDAAGTIHDYVVAMLCGLPRPLMSDQNAASWGYFNTQSQSWNVETLRSSGFPVHLLPDIAEPGSVAGRTSHMWFEIPKGTQVGVALGDLQASVYSCMAQRTDAVLNISTSVQLAASMPSGFQPAQTPDPTAPVAYFPYFNRTYLGVAASLNGGNVLATFVHMLVQWMADLGLEVEESTVYSRMIQAAVQQRDTHLTITPTVLGERHLPDQLASVTRISSSDLSLGHVTRALCRGIVQNLHSMLPIQQLQEWGVERVMGSGSALSRNDVLKQEVQRAFPLPMSFGQDVDAAVGAALVMLRRHLNQKES

SEQ ID NO: 62 - protein, 370 aa, Homo sapiens
MKIKDAKKPSFPWFGMDIGGTLVKLSYFEPIDITAEEEQEEVESLKSIRKYLTSNVAYGSTGIRDVHLELKDLTLFGRRGNLHFIRFPTQDLPTFIQMGRDKNFSTLQTVLCATGGGAYKFEKDFRTIGNLHLHKLDELDCLVKGLLYIDSVSFNGQAECYYFANASEPERCQKMPFNLDDPYPLLVVNIGSGVSILAVHSKDNYKRVTGTSLGGGTFLGLCSLLTGCESFEEALEMASKGDSTQADKLVRDIYGGDYERFGLPGWAVASSFGNMIYKEKRESVSKEDLARATLVTITNNIGSVARMCAVNEKINRVVFVGNFLRVNTLSMKLLAYALDYWSKGQLKALFLEHEGYFGAVGALLGLPNFS

SEQ ID NO: 63 - protein, 479 aa, Homo sapiens
MDATIAPHRIPPEMPQYGEENHIFELMQNMLEQLLIHQPEDPIPFMIQHLHRDNDNVPRIVILGPPASGKTTIAMWLCKHLNSSLLTLENLILNEFSYTATEARRLYLQRKTVPSALLVQLIQERLAEEDCIKQGWILDGIPETREQALRIQTLGITPRHVIVLSAPDTVLIERNLGKRIDPQTGEIYHTTFDWPPESEIQNRLMVPEDISELETAQKLLEYHRNIVRVIPSYPKILKVISADQPCVDVFYQALTYVQSNHRTNAPFTPRVLLLGPVGSGKSLQAALLAQKYRLVNVCCGQLLKEAVADRTTFGELIQPFFEKEMAVPDSLLMKVLSQRLDQQDCIQKGWVLHGVPRDLDQAHLLNRLGYNPNRVFFLNVPFDSIMERLTLRRIDPVTGERYHLMYKPPPTMEIQARLLQNPKDAEEQVKLKMDLFYRNSADLEQLYGSAITLNGDQDPYTVFEYIESGIINPLPKKIP

SEQ ID NO: 64 - protein, 560 aa, Homo sapiens
MRDLPLTSLALVLSALGALLGTEALRAEEPAVGTSGLIFREDLDWPPGSPQEPLCLVALGGDSNGSSSPLRVVGALSAYEQAFLGAVQRARWGPRDLATFGVCNTGDRQAALPSLRRLGAWLRDPGGQRLVVLHLEEVTWEPTPSLRFQEPPPGGAGPPELALLVLYPGPGPEVTVTRAGLPGAQSLCPSRDTRYLVLAVDRPAGAWRGSGLALTLQPRGEDSRLSTARLQALLFGDDHRCFTRMTPALLLLPRSEPAPLPAHGQLDTVPFPPPRPSAELEESPPSADPFLETLTRLVRALRVPPARASAPRLALDPDALAGFPQGLVNLSDPAALERLLDGEEPLLLLLRPTAATTGDPAPLHDPTSAPWATALARRVAAELQAAAAELRSLPGLPPATAPLLARLLALCPGGPGGLGDPLRALLLLKALQGLRVEWRGRDPRGPGRAQRSAGATAADGPCALRELSVDLRAERSVLIPETYQANNCQGVCGWPQSDRNPRYGNHVVLLLKMQARGAALARPPCCVPTAYAGKLLISLSEERISAHHVPNMVATECGCR

SEQ ID NO: 65 - protein, 813 aa, Homo sapiens
MDATALERDAVQFARLAVQRDHEGRYSEAVFYYKEAAQALIYAEMAGSSLENIQEKITEYLERVQALHSAVQSKSADPLKSKHQLDLERAHFLVTQAFDEDEKENVEDAIELYTEAVDLCLKTSYETADKVLQNKLKQLARQALDRAEALSEPLTKPVGKISSTSVKPKPPPVRAHFPLGANPFLERPQSFISPQSCDAQGQRYTAEEIEVLRTTSKINGIEYVPFMNVDLRERFAYPMPFCDRWGKLPLSPKQKTTFSKWVRPEDLTNNPTMIYTVSSFSIKQTIVSDCSFVASLAISAAYERRFNKKLITGIIYPQNKDGEPEYNPCGKYMVKLHLNGVPRKVIIDDQLPVDHKGELLCSYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHSTWDAKQGPVKDAYSLANNPQYKLEVQCPQGGAAVWVLLSRHITDKDDFANNREFITMVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPRQYSVGFEVVTVSTLGDPGPHGFLRKSSGDYRCGFCYLELENIPSGIFNIIPSTFLPKQEGPFFLDFNSIIPIKITQLQ

SEQ ID NO: 66 - protein, 406 aa, Homo sapiens
MAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 67 - protein, 366 aa, Homo sapiens
MTSCLPALRFIATPRLSAMPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 68 - protein, 348 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 69 - protein, 348 aa, Homo sapiens; identical to SEQ ID NO: 68

SEQ ID NO: 70 - protein, 348 aa, Homo sapiens; identical to SEQ ID NO: 68

SEQ ID NO: 71 - protein, 277 aa, Homo sapiens
MQPFSIPVQITLQGSRRRQGRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 72 - protein, 257 aa, Homo sapiens
MTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 73 - protein, 275 aa, Homo sapiens
MFPLLYELTAVSPSPFPQRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 74 - protein, 279 aa, Homo sapiens
MDFSPSSELGFHFVAFILLTRHRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 75 - protein, 173 aa, Homo sapiens
MQPFSIPVQITLQGSRRRQGRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKRDVTDCRVKEKQTLTVSDEHKQ

SEQ ID NO: 76 - protein, 1137 aa, Homo sapiens
MPLSSHLLPALVLFLAGSSGWAWVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 77 - protein, 285 aa, Homo sapiens
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 78 - protein, 286 aa, Homo sapiens
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRDEL

SEQ ID NO: 79 - protein, 250 aa, Homo sapiens
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 80 - protein, 250 aa, Homo sapiens
MPGARSGGSGGDGSNSGSYSGDASGAVTVWEVVSLLGKLLGTVVALKVVLYLLRVCLAMAWKSGGASHSELIHNLRSFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 81 - protein, 251 aa, Homo sapiens
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRDEL

SEQ ID NO: 82 - protein, 285 aa, Homo sapiens; identical to SEQ ID NO: 77

SEQ ID NO: 83 - protein, 552 aa, Homo sapiens
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 84 - protein, 386 aa, Homo sapiens [sequence omitted]

SEQ ID NO: 85 - protein, 2377 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 86 - protein, 2366 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 87 - protein, 2343 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 88 - protein, 2332 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 89 - protein, 2321 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 90 - protein, 2306 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 91 - protein, 2298 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 92 - protein, 2284 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 93 - protein, 2273 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 94 - protein, 2266 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 95 - protein, 2261 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 96 - protein, 2250 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 97 - protein, 2243 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 98 - protein, 2171 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 99 - protein, 2314 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 100 - protein, 2291 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMADLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 101 - protein, 2287 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 102 - protein, 2277 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 103 - protein, 2259 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 104 - protein, 2250 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 105 - protein, 2239 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 106 - protein, 2232 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 107 - protein, 2227 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 108 - protein, 2205 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 109 - protein, 2194 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 110 - protein, 2257 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 111 - protein, 2248 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 112 - protein, 2246 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 113 - DNA, 19 bp, Artificial sequence
  siRNA target sequence
ttcctggacatcacttccc

SEQ ID NO: 114 - DNA, 19 bp, Artificial sequence
  siRNA target sequence
ggttacctaagggtgtggc

SEQ ID NO: 115 - DNA, 19 bp, Artificial sequence
  siRNA target sequence
cagtgttacacggctttcc

SEQ ID NO: 116 - DNA, 19 bp, Artificial sequence
  siRNA target sequence
tggattggtcatcctggtc

SEQ ID NO: 117 - DNA, 19 bp, Artificial sequence
  siRNA target sequence
ttgttgagcttcacctatc

SEQ ID NO: 118 - DNA, 19 bp, Artificial sequence
  siRNA target sequence
gagcatgaccgatggattc

SEQ ID NO: 119 - DNA, 19 bp, Artificial sequence
  siRNA target sequence
gattaccttgcctgttgac

SEQ ID NO: 120 - DNA, 19 bp, Artificial sequence
  siRNA target sequence
gcacatatcgaggtgaaca

SEQ ID NO: 121 - DNA, 19 bp, Artificial sequence
  siRNA target sequence
tgatgtgtatctggtgacc

SEQ ID NO: 122 - DNA, 19 bp, Artificial sequence
  siRNA target sequence
gccacaacgtctatatcat

SEQ ID NO: 123 - DNA, 19 bp, Artificial sequence
  siRNA target sequence
atatcgaggtgaacatcac

SEQ ID NO: 124 - DNA, 19 bp, Artificial sequence
  siRNA target sequence
gcataaggctatgaagaga

SEQ ID NO: 125 - DNA, 19 bp, Artificial sequence
  siRNA target sequence
tgatggcaccttcattggc

SEQ ID NO: 126 - DNA, 19 bp, Artificial sequence
  siRNA target sequence
gatcatgcagcatcgcttc

SEQ ID NO: 127 - DNA, 19 bp, Artificial sequence
  siRNA target sequence
aacctataggctcaggagc

SEQ ID NO: 128 - DNA, 19 bp, Artificial sequence
  siRNA target sequence
gcagagtaatgctccatca

SEQ ID NO: 129 - DNA, 19 bp, Artificial sequence
  siRNA target sequence
ggccacccgaatctgaaat

SEQ ID NO: 130 - DNA, 19 bp, Artificial sequence
  siRNA target sequence
ggatgctgaagagcaggtc

SEQ ID NO: 131 - DNA, 19 bp, Artificial sequence
  siRNA target sequence
atacacagtcttcgaatac

SEQ ID NO: 132 - DNA, 19 bp, Artificial sequence
  siRNA target sequence
agacctaccaggccaacaa

SEQ ID NO: 133 - DNA, 19 bp, Artificial sequence
  siRNA target sequence
ctaccaggccaacaattgc

SEQ ID NO: 134 - DNA, 19 bp, Artificial sequence
  siRNA target sequence
cagcagcccatcatgaacc

SEQ ID NO: 135 - DNA, 19 bp, Artificial sequence
  siRNA target sequence
gggcggccctttatttcat

SEQ ID NO: 136 - DNA, 19 bp, Artificial sequence
  siRNA target sequence
tgacagtgaaggtggtggc

SEQ ID NO: 137 - DNA, 19 bp, Artificial sequence
  siRNA target sequence
gaattaacagccctcatta

SEQ ID NO: 138 - DNA, 19 bp, Artificial sequence
  siRNA target sequence
aatagtatcggattgctcc

SEQ ID NO: 139 - DNA, 19 bp, Artificial sequence
  siRNA target sequence
ggcaagaatggatccacta

SEQ ID NO: 140 - DNA, 19 bp, Artificial sequence
  siRNA target sequence
tgtgggactatacgattcc

SEQ ID NO: 141 - DNA, 19 bp, Artificial sequence
  siRNA target sequence
gagctgacttcgtgatgct

SEQ ID NO: 142 - DNA, 19 bp, Artificial sequence
  siRNA target sequence
gaagagctcatcctttctg

SEQ ID NO: 143 - DNA, 19 bp, Artificial sequence
  siRNA target sequence
tatagcctcgttcagtggc

SEQ ID NO: 144 - DNA, 19 bp, Artificial sequence
  siRNA target sequence
cacagatatcatggacgac

SEQ ID NO: 145 - DNA, 19 bp, Artificial sequence
  siRNA target sequence
tgactctgctaggtggtgc

SEQ ID NO: 146 - DNA, 19 bp, Artificial sequence
  siRNA target sequence
gtggctctggatgatctgc

SEQ ID NO: 147 - DNA, 19 bp, Artificial sequence
  siRNA target sequence
gatcgtgtttgaagccact

SEQ ID NO: 148 - DNA, 19 bp, Artificial sequence
  siRNA target sequence
ttactgctcctttgaggac

SEQ ID NO: 149 - DNA, 19 bp, Artificial sequence
  siRNA target sequence
atgaactgcatgaggatac

SEQ ID NO: 150 - DNA, 19 bp, Artificial sequence
  siRNA target sequence
ggaatgaccgcttgtggat

SEQ ID NO: 151 - DNA, 19 bp, Artificial sequence
  siRNA target sequence
gaaaggagtctgactattc

SEQ ID NO: 152 - DNA, 19 bp, Artificial sequence
  siRNA target sequence
gtaaagggcttgctgtata

SEQ ID NO: 153 - DNA, 19 bp, Artificial sequence
  siRNA target sequence
gtgtgctgttaatgagaaa

SEQ ID NO: 154 - DNA, 19 bp, Artificial sequence
  siRNA target sequence
taacgtggcatatggatcc

SEQ ID NO: 155 - DNA, 19 bp, Artificial sequence
  siRNA target sequence
gtggtctcactcttgggaa

SEQ ID NO: 156 - DNA, 19 bp, Artificial sequence
  siRNA target sequence
gtgatgctggctacagacc

SEQ ID NO: 157 - DNA, 19 bp, Artificial sequence
  siRNA target sequence
gcaaaccgtatgacattat

SEQ ID NO: 158 - DNA, 19 bp, Artificial sequence
  siRNA target sequence
gatagccgatttcggatta

SEQ ID NO: 159 - DNA, 19 bp, Artificial sequence
  siRNA target sequence
gatttgcccagttacttat

SEQ ID NO: 160 - DNA, 19 bp, Artificial sequence
  siRNA target sequence
tgtcctgttggatgcacac

SEQ ID NO: 161 - DNA, 19 bp, Artificial sequence
  siRNA target sequence
tcatcctctttgccatggc

SEQ ID NO: 162 - DNA, 19 bp, Artificial sequence
  siRNA target sequence
gtcgtccaaagcagaagcc

SEQ ID NO: 163 - DNA, 19 bp, Artificial sequence
  siRNA target sequence
ggaagcctggaggtttatc

SEQ ID NO: 164 - DNA, 19 bp, Artificial sequence
  siRNA target sequence
tggctacacggtgtttagc

SEQ ID NO: 165 - DNA, 19 bp, Artificial sequence
  siRNA target sequence
agagatggtgatggtggtc

SEQ ID NO: 166 - DNA, 19 bp, Artificial sequence
  siRNA target sequence
cttcatcgtgctagagaat

SEQ ID NO: 167 - DNA, 19 bp, Artificial sequence
  siRNA target sequence
ttcatcgtgctagagaatc

SEQ ID NO: 168 - DNA, 19 bp, Artificial sequence
  siRNA target sequence
gcaggatgtgagtagaatc

SEQ ID NO: 169 - DNA, 19 bp, Artificial sequence
  siRNA target sequence
gcaaccatcttctggcttt

SEQ ID NO: 170 - DNA, 19 bp, Artificial sequence
  siRNA target sequence
gagatacccacctgaccat

SEQ ID NO: 171 - DNA, 19 bp, Artificial sequence
  siRNA target sequence
tgatgtccgaccagaatgc

SEQ ID NO: 172 - RNA, 12 nt, Artificial sequence
  Loop sequence
guuugcuauaac

SEQ ID NO: 173 - DNA, 19 bp, Artificial sequence
  siRNA target sequence
gagatctcactgactacct

SEQ ID NO: 174 - DNA, 19 bp, Artificial sequence
  siRNA target sequence
gcagtcaagtttccacaac

SEQ ID NO: 175 - DNA, 19 bp, Artificial sequence
  siRNA target sequence
gttatgtagctctggactt

SEQ ID NO: 176 - DNA, 18 bp, Artificial sequence
  Forward primer
accctgtgctgctcaccg

SEQ ID NO: 177 - DNA, 23 bp, Artificial sequence
  Reverse primer
aggtctcaaacatgatctgggtc

We claim:

1. An in vitro method for identifying a compound that inhibits fibroblast migration or differentiation, said method comprising:
   a) contacting a test compound with a polypeptide comprising the amino acid sequence of SEQ ID NO: 57 or 58, or with a cell expressing said polypeptide;
   b) measuring a binding affinity of the test compound to said polypeptide, or measuring expression, amount or an activity of said polypeptide;
   c) contacting the test compound with a population of fibroblasts;
   d) measuring fibroblast migration or differentiation; and
   e) identifying a compound capable of inhibiting fibroblast migration or differentiation and demonstrating binding affinity to said polypeptide or reducing or inhibiting the expression, amount or an activity of said polypeptide.

2. The method according to claim 1, wherein said polypeptide sequence in steps (a) and (b) is present in an in vitro cell-free preparation.

3. The method according to claim 1, wherein said test compound is selected from the group consisting of an antisense polynucleotide, a ribozyme, short-hairpin RNA (shRNA), microRNA (miRNA) and a small interfering RNA (siRNA).

4. The method according to claim 3, wherein said test compound comprises a nucleic acid sequence complementary to, or engineered from, a naturally-occurring polynucleotide sequence of about 17 to about 30 contiguous nucleotides of a nucleic acid sequence selected from the group consisting of SEQ ID NO: 1-2.

5. The method according to claim 3, wherein said antisense polynucleotide, said siRNA or said shRNA comprise an antisense strand of 17-25 nucleotides complementary to a sense strand, wherein said sense strand is selected from 17-25 continuous nucleotides of a nucleic acid sequence selected from the group consisting of SEQ ID NO: 1-2.

6. An in vitro method for identifying a compound that inhibits fibroblast migration and differentiation, said method comprising:
   a) contacting a test compound with a polypeptide comprising the amino acid sequence of SEQ ID NO: 57 or 58;
   b) measuring the expression or an activity of said polypeptide;
   c) contacting the test compound with a population of fibroblasts;
   d) measuring fibroblast migration or differentiation; and
   e) identifying a compound capable of inhibition of fibroblast migration or differentiation and inhibiting the expression or an activity of said polypeptide.

7. The method according to claim 1 or 6, which additionally comprises the step of comparing the compound to be tested to a control.

8. The method of claim 1 or 6 wherein said polypeptide is coupled to a detectable label.

9. The method according to claim 1 or 6, wherein said polypeptide sequence in steps (a) and (b) is present in a cell.

10. The method according to claim 9, wherein the cell naturally expresses said polypeptide.

11. The method according to claim 9, wherein the cell has been engineered so as to express said polypeptide.

12. The method according to claim 9, wherein said cell is a mammalian cell.

13. The method according to claim 12, wherein said cell is a fibroblast.

14. The method according to claim 13, wherein said cell is a human lung fibroblast.

15. The method of claim 1 or 6, wherein fibroblast migration is measured.

16. The method according to claim 15, wherein said fibroblasts have been triggered by a migration-inducing factor.

17. The method according to claim 16, wherein said migration-inducing factor is selected from the group consisting of CCLs, CXCLs, IL13, CTGF and PDGF-BB.

18. The method according to claim 17, wherein CCLs are selected from the group consisting of CCL3, CCL7, CCL13, CCL27, CCL22, CCL21, CCL15, CCL17, CCL18, CCL19 and CCL20 and CXCLs are selected from the group consisting of CXCL1, CXCL8 and CXCL12.

19. The method of claim 15 wherein migration is measured by closure of a mechanically induced scratch wound in a monolayer.

20. The method of claim 1 or 6, wherein differentiation of fibroblasts into myofibroblasts is measured.

21. The method according to claim 20, wherein said fibroblasts have been triggered by a fibroblast-to-myofibroblast differentiation factor.

22. The method according to claim 21, wherein said fibroblast-to-myofibroblast differentiation factor is TGFβ.

23. The method according to claim 20, wherein differentiation of fibroblasts into myofibroblasts is measured as a decrease in production and/or expression of a marker of fibroblast-to-myofibroblast differentiation.

24. The method of claim 23, wherein said marker is selected from the group consisting of α-smooth muscle actin, collagens, and connective tissue growth factor.

25. The method according to claim 1 or 6, wherein said compound is an antibody or an antibody fragment.

* * * * *